United States Patent
Segura et al.

(10) Patent No.: US 9,458,441 B2
(45) Date of Patent: Oct. 4, 2016

(54) POLYPEPTIDES HAVING XANTHAN DEGRADING ACTIVITY AND POLYNUCLEOTIDES ENCODING SAME

(71) Applicant: Novozymes A/S, Bagsvaerd (DK)

(72) Inventors: Dorotea Raventos Segura, Rungsted (DK); Peter Fischer Halin, Holte (DK); Lars Anderson, Malmoe (SE); Martin Simon Borchert, Hilleroed (DK); Leigh Murphy, Roskilde (DK); Astrid Boisen, Soeborg (DK); Lorena G. Palmen, Malmoe (SE); Kenneth Jensen, Oelsted (DK); Carsten Sjoeholm, Virum (DK); Tine Hoff, Holte (DK); Charlotte Blom, Lynge (DK); Anders Viksoe-Nielsen, Slangerup (DK)

(73) Assignee: Novozymes A/S, Bagsvaerd (DK)

( * ) Notice: Subject to any disclaimer, the term of this patent is extended or adjusted under 35 U.S.C. 154(b) by 9 days.

(21) Appl. No.: 14/395,165

(22) PCT Filed: May 7, 2013

(86) PCT No.: PCT/EP2013/059472
§ 371 (c)(1),
(2) Date: Oct. 17, 2014

(87) PCT Pub. No.: WO2013/167581
PCT Pub. Date: Nov. 14, 2013

(65) Prior Publication Data
US 2015/0132824 A1    May 14, 2015

Related U.S. Application Data

(60) Provisional application No. 61/644,033, filed on May 8, 2012, provisional application No. 61/754,663, filed on Jan. 21, 2013.

(30) Foreign Application Priority Data

May 7, 2012   (EP) .................................... 12167023
Jan. 10, 2013  (EP) .................................... 13150833

(51) Int. Cl.
| | | |
|---|---|---|
| C12N 9/24 | (2006.01) |
| C11D 3/38 | (2006.01) |
| C09K 8/08 | (2006.01) |
| C12N 9/42 | (2006.01) |
| C11D 3/386 | (2006.01) |
| C12N 9/88 | (2006.01) |

(52) U.S. Cl.
CPC ............... *C12N 9/2437* (2013.01); *C09K 8/08* (2013.01); *C11D 3/38636* (2013.01); *C11D 3/38645* (2013.01); *C12N 9/88* (2013.01); *C12Y 302/01004* (2013.01); *C12Y 402/02012* (2013.01)

(58) Field of Classification Search
None
See application file for complete search history.

(56) References Cited

U.S. PATENT DOCUMENTS

| 4,996,153 | A | 2/1991 | Cadmus |
| 8,044,011 | B2 | 10/2011 | Warkotsch et al. |
| 2008/0176770 | A1 | 7/2008 | Sanders et al. |
| 2008/0229514 | A1 | 9/2008 | Poulose et al. |
| 2011/0117067 | A1 | 5/2011 | Esteghlalian |
| 2011/0136720 | A1 | 6/2011 | O'Connell et al. |
| 2015/0132824 | A1 | 5/2015 | Segura et al. |

FOREIGN PATENT DOCUMENTS

| EP | 0030393 A1 | 6/1981 |
| EP | 0896998 A1 | 2/1999 |
| JP | 2002-78488 | 3/2002 |
| WO | 9909127 A1 | 2/1999 |
| WO | 2011080267 A2 | 7/2011 |

OTHER PUBLICATIONS

Henrissat et al., Biochem J., vol. 280, pp. 309-316 (1991).
Morohoshi et al., Journal of Bacteriology, vol. 193, No. 8, pp. 2520A-2526 (1999).
Morohoshi et al., UniProt Accession No. E8N9Z4 (1999).
Nankai et al., Applied and Environmental Microbiology, vol. 65, No. 6, pp. 2520-2526 (1999).
Qian et al., Journal of Applied Microbiology, vol. 102, No. 5, pp. 1362-1371 (2007).
Ruijssenaars et al., Applied and Environmental Microbiology, vol. 65, No. 6, pp. 2446-2452 (1999).
Ruijssenaars et al., Applied and Environmental Microbiology, vol. 66, No. 9, pp. 3945-3950 (2000).
Wellcome Trust Genome Campus, UniProt Access No. UPI0002012C2B (2013).
Hashimoto et al, 2003, J Biol Chem, vol. 278, No. 9, pp. 7663-7673.
Li et al, 2009, Appl Biochem Biotech, vol. 159, No. 1, pp. 24-32.
Sutherland, 1987, J Gen Micro, vol. 133, pp. 3129-3134.

*Primary Examiner* — Suzanne M Noakes
(74) *Attorney, Agent, or Firm* — Kristin McNamara

(57) ABSTRACT

The present invention relates to isolated polypeptides having xanthan degrading activity, catalytic domains and polynucleotides encoding the polypeptides and catalytic domains. The invention also relates to nucleic acid constructs, vectors, and host cells comprising the polynucleotides as well as methods of producing and using the polypeptides and catalytic domains.

20 Claims, 1 Drawing Sheet

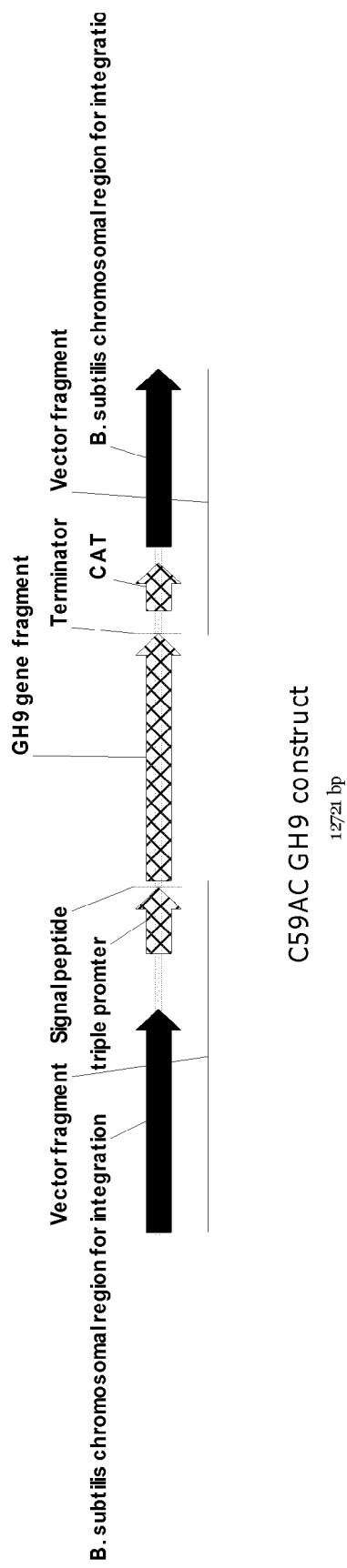

US 9,458,441 B2

POLYPEPTIDES HAVING XANTHAN DEGRADING ACTIVITY AND POLYNUCLEOTIDES ENCODING SAME

CROSS-REFERENCE TO RELATED APPLICATIONS

This application is a 35 U.S.C. 371 national application of PCT/EP2013/059472 filed May 7, 2013, which claims priority or the benefit under 35 U.S.C. 119 of European application nos. 12167023.6 and 13150833.5 filed May 7, 2012 and Jan. 10, 2013, respectively, and U.S. provisional application Nos. 61/644,033 and 61/754,663 and filed May 8, 2012 and Jan. 21, 2013, respectively. The contents of each application are fully incorporated herein by reference.

REFERENCE TO A SEQUENCE LISTING

This application contains a Sequence Listing in computer readable form, which is incorporated herein by reference.

BACKGROUND OF THE INVENTION

1. Field of the Invention

The present invention relates to polypeptides having xanthan degrading activity, in particular xanthan lyase activity and to GH9 endoglucanases having activity on xanthan gum pretreated with xanthan lyase, catalytic domains, and polynucleotides encoding the polypeptides and catalytic domains. The invention also relates to nucleic acid constructs, vectors, and host cells comprising the polynucleotides as well as methods of producing and using the polypeptides and catalytic domains. The invention further relates to compositions comprising GH9 endoglucanases and/or xanthan lyases for use in detergents and in the drilling and oil industries.

2. Description of the Related Art

Xanthan gum is a polysaccharide derived from the bacterial coat of *Xanthomonas campestris*. It is produced by the fermentation of glucose, sucrose, or lactose by the *Xanthomonas campestris* bacterium. After a fermentation period, the polysaccharide is precipitated from a growth medium with isopropyl alcohol, dried, and ground into a fine powder. Later, it is added to a liquid medium to form the gum.

Xanthan gum is a natural polysaccharide consisting of different sugars which are connected by several different bonds, such as β-D-mannosyl-β-D-1,4-glucuronosyl bonds and β-D-glucosyl-β-D-1,4-glucosyl bonds. Xanthan gum is at least partly soluble in water and forms highly viscous solutions or gels.

Complete enzymatic degradation of xanthan gum requires several enzymatic activities including xanthan lyase activity and endo-β-1,4-glucanase activity. Xanthan lyases are enzymes that cleave the β-D-mannosyl-β-D-1,4-glucuronosyl bond of xanthan and have been described in the literature. Xanthan degrading enzymes are known in the art e.g. have two xanthan lyases been isolated from *Paenibacillus alginolyticus* XL-1 (e.g. Ruijssenaars et al. (1999) 'A pyruvated mannose-specific xanthan lyase involved in xanthan degradation by *Paenibacillus alginolyticus* XL-1', *Appl. Environ. Microbiol.* 65(6): 2446-2452, and Ruijssenaars et al. (2000), 'A novel gene encoding xanthan lyase of *Paenibacillus alginolyticus* strain XL-1', *Appl. Environ. Microbiol.* 66(9): 3945-3950).

Glycoside hydrolases are enzymes that catalyse the hydrolysis of the glycosyl bond to release smaller sugars. There are over 100 classes of glycoside hydrolases which have been classified, see Henrissat et al. (1991) 'A classification of glycosyl hydrolases based on amino-acid sequence similarities', *J. Biochem.* 280: 309-316 and the Uniprot website at www.cazy.org. The glycoside hydrolase family 9 (GH9) consists of over 70 different enzymes that are mostly endoglucanases (EC 3.2.1.4), cellobiohydrolases (EC 3.2.1.91), β-glucosidases (EC 3.2.1.21) and exo-β-glucosaminidase (EC 3.2.1.165). A GH9 from *Microbacterium testaceum* StLB037 having 84.5% sequence identity to SEQ ID NO: 12, 79.1% sequence identity to SEQ ID NO: 10 and 74.0% sequence identity to SEQ ID NO: 14 has been published by T. Morohoshi et al, (2011) *J. Bacteriol.* 193(8), 2072-2073.

In recent years xanthan gum has been use as an ingredient in many consumer products including foods (e.g. as thickening agent in salat dressings and dairy products) and cosmetics (e.g. as stabilizer and thickener in toothpaste and make-up to prevent ingredients from separating) and cosmetics (such as sun creams). Further xanthan gum has found use in the oil industry as well as an additive to regulate the viscosity of drilling fluids etc. The widespread use of xanthan gum has led to a desire to degrade solutions or gels of xanthan gum thereby allowing easier removal of the byproducts. It has been suggested to add a xanthan lyase to a detergent composition in order to remove xanthan gum containing stains, e.g. in EP0896998A, but this publication does not contain any experimental data demonstrating any effect thereof.

The invention provides new and improved enzymes for the degradation of xanthan gum and the use of such enzymes for cleaning purposes, such as the removal of xanthan gum stains, and in the drilling and oil industries.

SUMMARY OF THE INVENTION

In one aspect the invention relates to an isolated GH9 endoglucanase having activity on xanthan gum pretreated with xanthan lyase, selected from the group consisting of:
 (a) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 2;
 (b) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 10;
 (c) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 12;
 (d) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 14;

(e) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 48;

(f) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 52;

(g) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 56;

(h) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 82;

(i) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 86;

(j) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 90;

(k) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 94;

(l) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 98;

(m) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 102;

(n) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 130;

(o) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 134;

(p) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 138;

(q) a polypeptide encoded by a polynucleotide that hybridizes under medium stringency conditions, medium-high stringency conditions, high stringency conditions, or very high stringency conditions with:
  (i) the mature polypeptide coding sequence of SEQ ID NO: 1;
  (ii) the mature polypeptide coding sequence of SEQ ID NO: 9;
  (iii) the mature polypeptide coding sequence of SEQ ID NO: 11;
  (iv) the mature polypeptide coding sequence of SEQ ID NO: 13;
  (v) the mature polypeptide coding sequence of SEQ ID NO: 47;
  (vi) the mature polypeptide coding sequence of SEQ ID NO: 51;
  (vii) the mature polypeptide coding sequence of SEQ ID NO: 55;
  (viii) the mature polypeptide coding sequence of SEQ ID NO: 81;
  (ix) the mature polypeptide coding sequence of SEQ ID NO: 85;
  (x) the mature polypeptide coding sequence of SEQ ID NO: 89;
  (xi) the mature polypeptide coding sequence of SEQ ID NO: 93;
  (xii) the mature polypeptide coding sequence of SEQ ID NO: 97;
  (xiii) the mature polypeptide coding sequence of SEQ ID NO: 101;
  (xiv) the mature polypeptide coding sequence of SEQ ID NO: 129;
  (xv) the mature polypeptide coding sequence of SEQ ID NO: 133;
  (xvi) the mature polypeptide coding sequence of SEQ ID NO: 137; or
  (xvii) the full-length complement thereof of (i), (ii), (iii), (iv), (v), (vi), (vii), (viii), (ix), (x), (xi), (xii), (xiii), (xiv), (xv), or (xvi);

(r) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 1;

(s) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 9;
(t) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 11;
(u) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 13;
(v) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 47;
(w) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 51;
(x) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 55;
(y) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 81;
(z) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 85;
(aa) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 89;
(ab) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 93;
(ac) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 97;
(ad) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 101;
(ae) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 129;
(af) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 133;
(ag) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 137;
(ah) a variant of the mature polypeptide of SEQ ID NO: 2, SEQ ID NO: 10, SEQ ID NO: 12, SEQ ID NO: 14, SEQ ID NO: 48, SEQ ID NO: 52, SEQ ID NO: 56, SEQ ID NO: 82, SEQ ID NO: 86, SEQ ID NO: 90, SEQ ID NO: 94, SEQ ID NO: 98, SEQ ID NO: 102, SEQ ID NO: 130, SEQ ID NO: 134 or SEQ ID NO: 138 comprising a substitution, deletion, and/or insertion at one or more positions (e.g. several); and
(ai) a fragment of the polypeptide of (a), (b), (c), (d), (e), (f), (g), (h), (i), (j), (k), (l), (m), (n), (o), (p), (q), (r), (s), (t), (u), (v), (w), (x), (y), (z), (aa), (ab), (ac), (ad), (ae), (af), (ag) or (ah) that has activity on xanthan gum pretreated with xanthan lyase, xanthan degrading activity and/or endo-β-1,4-glucanase activity.

In another aspect, the invention relates to an isolated polypeptide having xanthan lyase activity selected from the group consisting of:
- (a) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 4;
- (b) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 46;
- (c) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 60;
- (d) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 64;
- (e) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 106;
- (f) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 110;
- (g) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 114;
- (h) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 118;
- (i) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 122;
- (j) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 126;
- (k) a polypeptide encoded by a polynucleotide that hybridizes under medium stringency conditions, medium-high stringency conditions, high stringency conditions, or very high stringency conditions with:
  - (i) the mature polypeptide coding sequence of SEQ ID NO: 3;
  - (ii) the mature polypeptide coding sequence of SEQ ID NO: 45;
  - (iii) the mature polypeptide coding sequence of SEQ ID NO: 59;
  - (iv) the mature polypeptide coding sequence of SEQ ID NO: 63;
  - (v) the mature polypeptide coding sequence of SEQ ID NO: 105;
  - (vi) the mature polypeptide coding sequence of SEQ ID NO: 109;
  - (vii) the mature polypeptide coding sequence of SEQ ID NO: 113;
  - (viii) the mature polypeptide coding sequence of SEQ ID NO: 117;
  - (ix) the mature polypeptide coding sequence of SEQ ID NO: 121;
  - (x) the mature polypeptide coding sequence of SEQ ID NO: 125; or
  - (xi) the full-length complement thereof of (i), (ii), (iii), (iv), (v), (vi), (vii), (viii), (ix), or (x);
- (l) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 3;
- (m) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 45;
- (n) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 59;
- (o) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 63;
- (p) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 105;

(q) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 109;

(r) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 113;

(s) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 117;

(t) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 121, (u) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 125;

(v) a variant of the mature polypeptide of SEQ ID NO: 4, SEQ ID NO: 46, SEQ ID NO: 60, SEQ ID NO: 64, SEQ ID NO: 106, SEQ ID NO: 110, SEQ ID NO: 114, SEQ ID NO: 118, SEQ ID NO: 122 or SEQ ID NO: 126 comprising a substitution, deletion, and/or insertion at one or more positions (e.g. several); and (w) a fragment of the polypeptide of (a), (b), (c), (d), (e), (f), (g), (h), (i), (j), (k), (l), (m), (n), (o), (p), (q), (r), (s), (t), (u) or (v) that has xanthan lyase activity.

In another aspect, the invention relates to a composition comprising an isolated GH9 endoglucanase having activity on xanthan gum pretreated with xanthan lyase, according to the invention. In a further aspect, the composition further comprises an isolated polypeptide having xanthan lyase activity according to the invention. The composition of the invention is preferably a detergent composition comprising one or more detergent components or a composition for degrading xanthan gum.

It has surprisingly been found that the a composition comprising a xanthan lyase and a GH9 endoglucanase having activity on xanthan gum pretreated with xanthan lyase is significantly more efficient in degrading xanthan gum than would have been expected based on the activity of the individual enzymes.

The present invention also relates to isolated polynucleotides encoding the polypeptides of the present invention; nucleic acid constructs; recombinant expression vectors; recombinant host cells comprising the polynucleotides; and methods of producing the polypeptides.

The present invention further relates to the use of the composition of the invention for degrading xanthan gum, for washing or cleaning textiles and/or hard surfaces, such as dish wash, wherein the composition has an enzyme detergency benefit, or for controlling the viscosity of drilling fluids. The invention also relates to methods of degrading xanthan gum, wherein xanthan gum is on the surface of a hard surface or textile, wherein xanthan gum is used in fracturing of a subterranean formation perpetrated by a well bore, or wherein the xanthan gum is a component in borehole filtercake.

OVERVIEW OF SEQUENCE LISTING

SEQ ID NO: 1 is the DNA sequence of the GH9 endoglucanase as isolated from *Paenibacillus* sp NN062047.

SEQ ID NO: 2 is the amino acid sequence as deduced from SEQ ID NO: 1.

SEQ ID NO: 3 is the truncated DNA sequence of the xanthan lyase as isolated from *Paenibacillus* sp NN018054.

SEQ ID NO: 4 is the amino acid sequence as deduced from SEQ ID NO: 3.

SEQ ID NO: 5 is the DNA sequence of the recombinant expressed sequence from SEQ ID NO: 1 operably linked with a His-tag.

SEQ ID NO: 6 is the amino acid sequence as deduced from SEQ ID NO: 5.

SEQ ID NO: 7 is the DNA sequence of the recombinant expressed sequence from SEQ ID NO: 3 operably linked with a His-tag.

SEQ ID NO: 8 is the amino acid sequence as deduced from SEQ ID NO: 7.

SEQ ID NO: 9 is the DNA sequence of the GH9 endoglucanase as isolated from *Microbacterium* sp NN062149.

SEQ ID NO: 10 is the amino acid sequence as deduced from SEQ ID NO: 9.

SEQ ID NO: 11 is the DNA sequence of the GH9 endoglucanase as isolated from *Microbacterium* sp NN062148.

SEQ ID NO: 12 is the amino acid sequence as deduced from SEQ ID NO: 11.

SEQ ID NO: 13 is the DNA sequence of the GH9 endoglucanase as isolated from *Microbacterium* sp NN062045.

SEQ ID NO: 14 is the amino acid sequence as deduced from SEQ ID NO: 13.

SEQ ID NO: 15 is the DNA sequence of the recombinant expressed sequence from SEQ ID NO: 9 operably linked with a His-tag.

SEQ ID NO: 16 is the amino acid sequence as deduced from SEQ ID NO: 15.

SEQ ID NO: 17 is the DNA sequence of the recombinant expressed sequence from SEQ ID NO: 11 operably linked with a His-tag.

SEQ ID NO: 18 is the amino acid sequence as deduced from SEQ ID NO: 17.

SEQ ID NO: 19 is the DNA sequence of the recombinant expressed sequence from SEQ ID NO: 13 operably linked with a His-tag.

SEQ ID NO: 20 is the amino acid sequence as deduced from SEQ ID NO: 19.

SEQ ID NO: 21 is Primer D88F.

SEQ ID NO: 22 is Primer D89R.

SEQ ID NO: 23 is Primer D124F.

SEQ ID NO: 24 is Primer D125R.

SEQ ID NO: 25 is Primer D126F.

SEQ ID NO: 26 is Primer D127R.

SEQ ID NO: 27 is Primer D128F.

SEQ ID NO: 28 is Primer D129R.

SEQ ID NO: 29 is the DNA sequence of the Savinase signal peptide.

SEQ ID NO: 30 is the His-Tag (also called poly-histidine tag).

SEQ ID NO: 31 is Primer D117F.

SEQ ID NO: 32 is Primer D118R.

SEQ ID NO: 33 is Primer D158F.

SEQ ID NO: 34 is Primer D159R.

SEQ ID NO: 35 is Primer D168F.

SEQ ID NO: 36 is Primer D169R.

SEQ ID NO: 37 is Primer D170F.

SEQ ID NO: 38 is Primer D170R.

SEQ ID NO: 39 is Primer D171F.

SEQ ID NO: 40 is Primer D172R.

SEQ ID NO: 41 is Primer D160F.

SEQ ID NO: 42 is Primer D161R.

SEQ ID NO: 43 is Primer F-C3AQX.

SEQ ID NO: 44 is Primer R-C3AQX.

SEQ ID NO: 45 is the full length DNA sequence of the xanthan lyase as isolated from *Paenibacillus* sp NN018054.

SEQ ID NO: 46 is the amino acid sequence as deduced from SEQ ID NO: 45.

SEQ ID NO: 47 is the DNA sequence of the truncated GH9 endoglucanase as isolated from *Paenibacillus* sp NN062047

SEQ ID NO: 48 is the amino acid sequence as deduced from SEQ ID NO: 47.

SEQ ID NO: 49 is the DNA sequence of the recombinant expressed sequence from SEQ ID NO: 47 operably linked with a His-tag.

SEQ ID NO: 50 is the amino acid sequence as deduced from SEQ ID NO: 49.

SEQ ID NO: 51 is the DNA sequence of the truncated GH9 endoglucanase as isolated from *Paenibacillus* sp NN062047.

SEQ ID NO: 52 is the amino acid sequence as deduced from SEQ ID NO: 51.

SEQ ID NO: 53 is the DNA sequence of the recombinant expressed sequence from SEQ ID NO: 51 operably linked with a His-tag.

SEQ ID NO: 54 is the amino acid sequence as deduced from SEQ ID NO: 53.

SEQ ID NO: 55 is the DNA sequence of the GH9 endoglucanase as isolated from *Paenibacillus* sp NN062253.

SEQ ID NO: 56 is the amino acid sequence as deduced from SEQ ID NO: 55

SEQ ID NO: 57 is the DNA sequence of the recombinant expressed sequence from SEQ ID NO: 55 operably linked with a His-tag.

SEQ ID NO: 58 is the amino acid sequence as deduced from SEQ ID NO: 57.

SEQ ID NO: 59 is the DNA sequence of the xanthan lyase as isolated from *Paenibacillus* sp NN062250.

SEQ ID NO: 60 is the amino acid sequence as deduced from SEQ ID NO: 59.

SEQ ID NO: 61 is the DNA sequence of the recombinant expressed sequence from SEQ ID NO: 59 operably linked with a His-tag.

SEQ ID NO: 62 is the amino acid sequence as deduced from SEQ ID NO: 61.

SEQ ID NO: 63 is the DNA sequence of the xanthan lyase as isolated from *Paenibacillus* sp NN062047.

SEQ ID NO: 64 is the amino acid sequence as deduced from SEQ ID NO: 63.

SEQ ID NO: 65 is the DNA sequence of the recombinant expressed sequence from SEQ ID NO: 63 operably linked with a His-tag.

SEQ ID NO: 66 is the amino acid sequence as deduced from SEQ ID NO: 65.

SEQ ID NO: 67 is the DNA sequence of the recombinant expressed sequence from SEQ ID NO: 45 operably linked with a His-tag.

SEQ ID NO: 68 is the amino acid sequence as deduced from SEQ ID NO: 67.

SEQ ID NO: 69 is Primer D244F.

SEQ ID NO: 70 is Primer D245R.

SEQ ID NO: 71 is Primer D242F.

SEQ ID NO: 72 is Primer D243R.

SEQ ID NO: 73 is Primer D271F.

SEQ ID NO: 74 is Primer D272R.

SEQ ID NO: 75 is Primer D289F.

SEQ ID NO: 76 is Primer D290R.

SEQ ID NO: 77 is Primer D293F.

SEQ ID NO: 78 is Primer D294R.

SEQ ID NO: 79 is Primer D332F.

SEQ ID NO: 80 is Primer D333R.

SEQ ID NO: 81 is the DNA sequence of the GH9 endoglucanase as isolated from *Paenibacillus* sp NN062046.

SEQ ID NO: 82 is the amino acid sequence as deduced from SEQ ID NO: 81.

SEQ ID NO: 83 is the DNA sequence of the recombinant expressed sequence from SEQ ID NO: 81 operably linked with a His-tag.

SEQ ID NO: 84 is the amino acid sequence as deduced from SEQ ID NO: 83.

SEQ ID NO: 85 is the DNA sequence of the truncated GH9 endoglucanase as isolated from *Paenibacillus* sp NN018054.

SEQ ID NO: 86 is the amino acid sequence as deduced from SEQ ID NO: 85.

SEQ ID NO: 87 is the DNA sequence of the recombinant expressed sequence from SEQ ID NO: 85.

SEQ ID NO: 88 is the amino acid sequence as deduced from SEQ ID NO: 87.

SEQ ID NO: 89 is the DNA sequence of the GH9 endoglucanase as isolated from *Paenibacillus* sp NN062408.

SEQ ID NO: 90 is the amino acid sequence as deduced from SEQ ID NO: 89.

SEQ ID NO: 91 is the DNA sequence of the recombinant expressed sequence from SEQ ID NO: 89.

SEQ ID NO: 92 is the amino acid sequence as deduced from SEQ ID NO: 91.

SEQ ID NO: 93 is the DNA sequence of the GH9 endoglucanase as isolated from *Paenibacillus* sp NN018054.

SEQ ID NO: 94 is the amino acid sequence as deduced from SEQ ID NO: 93.

SEQ ID NO: 95 is the DNA sequence of the recombinant expressed sequence from SEQ ID NO: 93 operably linked with a His-tag.

SEQ ID NO: 96 is the amino acid sequence as deduced from SEQ ID NO: 95.

SEQ ID NO: 97 is the DNA sequence of the GH9 endoglucanase as isolated from *Paenibacillus* sp NN062332.

SEQ ID NO: 98 is the amino acid sequence as deduced from SEQ ID NO: 97.

SEQ ID NO: 99 is the DNA sequence of the recombinant expressed sequence from SEQ ID NO: 97 operably linked with a His-tag.

SEQ ID NO: 100 is the amino acid sequence as deduced from SEQ ID NO: 99.

SEQ ID NO: 101 is the DNA sequence of the GH9 endoglucanase as isolated from *Microbacterium testaceum*.

SEQ ID NO: 102 is the amino acid sequence as deduced from SEQ ID NO: 101.

SEQ ID NO: 103 is the DNA sequence of the recombinant expressed sequence from SEQ ID NO: 101 operably linked with a His-tag.

SEQ ID NO: 104 is the amino acid sequence as deduced from SEQ ID NO: 103.

SEQ ID NO: 105 is the DNA sequence of the xanthan lyase as isolated from *Paenibacillus* sp NN062147.

SEQ ID NO: 106 is the amino acid sequence as deduced from SEQ ID NO: 105.

SEQ ID NO: 107 is the DNA sequence of the recombinant expressed sequence from SEQ ID NO: 105 operably linked with a His-tag.

SEQ ID NO: 108 is the amino acid sequence as deduced from SEQ ID NO: 107.

SEQ ID NO: 109 is the DNA sequence of the xanthan lyase as isolated from *Paenibacillus* sp NN062193.

SEQ ID NO: 110 is the amino acid sequence as deduced from SEQ ID NO: 109.

SEQ ID NO: 111 is the DNA sequence of the recombinant expressed sequence from SEQ ID NO: 109 operably linked with a His-tag.

SEQ ID NO: 112 is the amino acid sequence as deduced from SEQ ID NO: 111.

SEQ ID NO: 113 is the DNA sequence of the xanthan lyase as isolated from *Paenibacillus* sp NN062408.

SEQ ID NO: 114 is the amino acid sequence as deduced from SEQ ID NO: 113.

SEQ ID NO: 115 is the DNA sequence of the recombinant expressed sequence from SEQ ID NO: 113 operably linked with a His-tag.

SEQ ID NO: 116 is the amino acid sequence as deduced from SEQ ID NO: 115.

SEQ ID NO: 117 is the DNA sequence of the xanthan lyase as isolated from *Paenibacillus* sp NN062332.

SEQ ID NO: 118 is the amino acid sequence as deduced from SEQ ID NO: 117.

SEQ ID NO: 119 is the DNA sequence of the recombinant expressed sequence from SEQ ID NO: 117 operably linked with a His-tag.

SEQ ID NO: 120 is the amino acid sequence as deduced from SEQ ID NO: 119.

SEQ ID NO: 121 is the DNA sequence of the xanthan lyase as isolated from *Paenibacillus* sp NN062046.

SEQ ID NO: 122 is the amino acid sequence as deduced from SEQ ID NO: 121.

SEQ ID NO: 123 is the DNA sequence of the recombinant expressed sequence from SEQ ID NO: 121 operably linked with a His-tag.

SEQ ID NO: 124 is the amino acid sequence as deduced from SEQ ID NO: 123.

SEQ ID NO: 125 is the DNA sequence of the xanthan lyase as isolated from *Paenibacillus* sp NN062253.

SEQ ID NO: 126 is the amino acid sequence as deduced from SEQ ID NO: 125.

SEQ ID NO: 127 is the DNA sequence of the recombinant expressed sequence from SEQ ID NO: 125 operably linked with a His-tag.

SEQ ID NO: 128 is the amino acid sequence as deduced from SEQ ID NO: 127.

SEQ ID NO: 129 is the DNA sequence of the xanthan lyase as isolated from *Microbacterium* sp NN062175.

SEQ ID NO: 130 is the amino acid sequence as deduced from SEQ ID NO: 129.

SEQ ID NO: 131 is the DNA sequence of the recombinant expressed sequence from SEQ ID NO: 129 operably linked with a His-tag.

SEQ ID NO: 132 is the amino acid sequence as deduced from SEQ ID NO: 131.

SEQ ID NO: 133 is the DNA sequence of the xanthan lyase as isolated from *Paenibacillus* sp NN062193.

SEQ ID NO: 134 is the amino acid sequence as deduced from SEQ ID NO: 133.

SEQ ID NO: 135 is the DNA sequence of the recombinant expressed sequence from SEQ ID NO: 133 operably linked with a His-tag.

SEQ ID NO: 136 is the amino acid sequence as deduced from SEQ ID NO: 135.

SEQ ID NO: 137 is the DNA sequence of the truncated xanthan lyase as isolated from *Paenibacillus* sp NN062193.

SEQ ID NO: 138 is the amino acid sequence as deduced from SEQ ID NO: 137.

SEQ ID NO: 139 is the DNA sequence of the recombinant expressed sequence from SEQ ID NO: 137 operably linked with a His-tag.

SEQ ID NO: 140 is the amino acid sequence as deduced from SEQ ID NO: 139.

SEQ ID NO: 141 is Primer F-0597B.
SEQ ID NO: 142 is Primer R-0597B.
SEQ ID NO: 143 is Primer F-05B9G.
SEQ ID NO: 144 is Primer R-05B9G.
SEQ ID NO: 145 is Primer F-059T2.
SEQ ID NO: 146 is Primer R-059T2.
SEQ ID NO: 147 is Primer F-C4AM9.
SEQ ID NO: 148 is Primer R-C4AM9.
SEQ ID NO: 149 is Primer F-C4AKF.
SEQ ID NO: 150 is Primer R-C4AKF.
SEQ ID NO: 151 is Primer F-059TM.
SEQ ID NO: 152 is Primer R-059TM.
SEQ ID NO: 153 is Primer F-059SY.
SEQ ID NO: 154 is Primer R-059SY.
SEQ ID NO: 155 is Primer F-C3AX4.
SEQ ID NO: 156 is Primer R-C3AX4.
SEQ ID NO: 157 is Primer F-C4AKA.
SEQ ID NO: 158 is Primer R-C4AKA.
SEQ ID NO: 159 is Primer F-C3BXT.
SEQ ID NO: 160 is Primer R-C3BXT.
SEQ ID NO: 161 is Primer F-0597E.
SEQ ID NO: 162 is Primer R-0597E.
SEQ ID NO: 163 is Primer F-0597F.
SEQ ID NO: 164 is Primer R-0597F.
SEQ ID NO: 165 is Primer F-C3FCE.
SEQ ID NO: 166 is Primer R-C3FCE.
SEQ ID NO: 167 is Primer D14KMG.
SEQ ID NO: 168 is Primer D14KMH.
SEQ ID NO: 169 is Primer D14N38.
SEQ ID NO: 170 is Primer D14N39.

Identity Matrix of GH9 Endoglucanase Sequences

|  | SEQ ID NO: 2 | SEQ ID NO: 10 | SEQ ID NO: 12 | SEQ ID NO: 14 | SEQ ID NO: 48 | SEQ ID NO: 52 | SEQ ID NO: 56 | SEQ ID NO: 82 | SEQ ID NO: 86 |
|---|---|---|---|---|---|---|---|---|---|
| SEQ 2 | 100 | 51.3 | 49.9 | 50.0 | 62.7 | 64.7 | 81.2 | 51.6 | 55.5 |
| SEQ 10 | 51.3 | 100 | 78.7 | 78.3 | 47.9 | 47.9 | 51.7 | 54.1 | 52.1 |
| SEQ 12 | 49.9 | 78.7 | 100 | 74.3 | 48.4 | 48.4 | 50.8 | 53.6 | 52.6 |
| SEQ 14 | 50.0 | 78.3 | 74.3 | 100 | 48.4 | 48.4 | 50.8 | 51.3 | 52.3 |
| SEQ 48 | 62.7 | 47.9 | 48.4 | 48.4 | 100 | 100 | 62.0 | 54.4 | 56.1 |
| SEQ 52 | 64.7 | 47.9 | 48.4 | 48.4 | 100 | 100 | 64.8 | 55.4 | 56.1 |
| SEQ 56 | 81.2 | 51.7 | 50.8 | 50.8 | 62.0 | 64.8 | 100 | 53.2 | 56.1 |
| SEQ 82 | 51.6 | 54.1 | 53.6 | 51.3 | 54.4 | 55.4 | 53.2 | 100 | 70.5 |
| SEQ 86 | 55.5 | 52.1 | 52.6 | 52.3 | 56.1 | 56.1 | 56.1 | 70.5 | 100 |
| SEQ 90 | 49.7 | 52.0 | 51.6 | 53.2 | 49.4 | 51.9 | 52.3 | 63.5 | 66.8 |
| SEQ 94 | 53.9 | 52.1 | 52.6 | 52.3 | 54.1 | 56.1 | 54.5 | 69.8 | 100 |
| SEQ 98 | 53.4 | 52.8 | 53.4 | 52.8 | 54.5 | 56.7 | 54.0 | 69.9 | 73.1 |
| SEQ 102 | 48.5 | 79.3 | 84.6 | 74.2 | 48.5 | 48.5 | 50.0 | 53.7 | 51.9 |
| SEQ 130 | 50.7 | 78.9 | 99.7 | 74.4 | 48.4 | 48.4 | 51.0 | 53.9 | 52.8 |
| SEQ 134 | 52.9 | 52.6 | 53.4 | 53.5 | 53.9 | 56.5 | 53.0 | 66.4 | 68.4 |
| SEQ 138 | 56.2 | 52.6 | 53.4 | 53.5 | 56.3 | 56.5 | 56.3 | 66.6 | 68.2 |

|  | SEQ ID NO: 90 | SEQ ID NO: 94 | SEQ ID NO: 98 | SEQ ID NO: 102 | SEQ ID NO: 130 | SEQ ID NO: 134 | SEQ ID NO: 138 |
|---|---|---|---|---|---|---|---|
| SEQ 2 | 49.7 | 53.9 | 53.4 | 48.5 | 50.7 | 52.9 | 56.2 |
| SEQ 10 | 52.0 | 52.1 | 52.8 | 79.3 | 78.9 | 52.6 | 52.6 |
| SEQ 12 | 51.6 | 52.6 | 53.4 | 84.6 | 99.7 | 53.4 | 53.4 |
| SEQ 14 | 53.2 | 52.3 | 52.8 | 74.2 | 74.4 | 53.5 | 53.5 |
| SEQ 48 | 49.4 | 54.1 | 54.5 | 48.5 | 48.4 | 53.9 | 56.3 |
| SEQ 52 | 51.9 | 56.1 | 56.7 | 48.5 | 48.4 | 56.5 | 56.5 |
| SEQ 56 | 52.3 | 54.5 | 54.0 | 50.0 | 51.0 | 53.0 | 56.3 |
| SEQ 82 | 63.5 | 69.8 | 69.9 | 53.7 | 53.9 | 66.4 | 66.6 |
| SEQ 86 | 66.8 | 100 | 73.1 | 51.9 | 52.8 | 68.4 | 68.2 |
| SEQ 90 | 100 | 67.7 | 68.0 | 52.0 | 52.1 | 64.3 | 64.9 |
| SEQ 94 | 67.7 | 100 | 72.8 | 51.9 | 52.8 | 68.2 | 68.2 |
| SEQ 98 | 68.0 | 72.8 | 100 | 54.2 | 53.5 | 67.7 | 67.9 |
| SEQ 102 | 52.0 | 51.9 | 54.2 | 100 | 84.7 | 52.2 | 52.2 |
| SEQ 130 | 52.1 | 52.8 | 53.5 | 84.7 | 100 | 53.5 | 53.5 |
| SEQ 134 | 64.3 | 68.2 | 67.7 | 52.2 | 53.5 | 100 | 100 |
| SEQ 138 | 64.9 | 68.2 | 67.9 | 52.2 | 53.5 | 100 | 100 |

Identity Matrix of Xanthan Lyase Sequences

|  | SEQ ID NO: 4 | SEQ ID NO: 46 | SEQ ID NO: 60 | SEQ ID NO: 64 | SEQ ID NO: 106 | SEQ ID NO: 110 | SEQ ID NO: 114 | SEQ ID NO: 118 | SEQ ID NO: 122 | SEQ ID NO: 126 |
|---|---|---|---|---|---|---|---|---|---|---|
| SEQ ID NO: 4 | 100 | 100 | 50.8 | 66.1 | 52.1 | 53.3 | 50.3 | 53 | 55.8 | 66.2 |
| SEQ ID NO: 46 | 100 | 100 | 48.4 | 62.0 | 49.4 | 50.8 | 47.9 | 50.3 | 49.1 | 64.9 |
| SEQ ID NO: 60 | 50.8 | 48.4 | 100 | 51.7 | 64.5 | 68.9 | 63.6 | 68.9 | 46.8 | 46.5 |
| SEQ ID NO: 64 | 66.1 | 62.0 | 51.7 | 100 | 52.9 | 52.1 | 51.8 | 53.5 | 52.2 | 81.1 |
| SEQ ID NO: 106 | 52.1 | 49.4 | 64.5 | 52.9 | 100 | 64.3 | 60.6 | 63.8 | 47.6 | 48.0 |
| SEQ ID NO: 110 | 53.3 | 50.8 | 68.9 | 52.1 | 64.3 | 100 | 64.2 | 67.3 | 47.2 | 49.5 |
| SEQ ID NO: 114 | 50.3 | 47.9 | 63.6 | 51.8 | 60.6 | 64.2 | 100 | 65.4 | 45.6 | 48.6 |
| SEQ ID NO: 118 | 53 | 50.3 | 68.9 | 53.5 | 63.8 | 67.3 | 65.4 | 100 | 48.0 | 49.6 |
| SEQ ID NO: 122 | 55.8 | 49.1 | 46.8 | 52.2 | 47.6 | 47.2 | 45.6 | 48.0 | 100 | 55.9 |
| SEQ ID NO: 126 | 66.2 | 64.9 | 46.5 | 81.1 | 48.0 | 49.5 | 48.6 | 49.6 | 55.9 | 100 |

SHORT DESCRIPTION OF THE FIGURE

FIG. 1 shows a plasmid map of the linear vector with gene insert for SEQ ID NO: 87.

DEFINITIONS

Allelic variant: The term "allelic variant" means any of two or more alternative forms of a gene occupying the same chromosomal locus. Allelic variation arises naturally through mutation, and may result in polymorphism within populations. Gene mutations can be silent (no change in the encoded polypeptide) or may encode polypeptides having altered amino acid sequences. An allelic variant of a polypeptide is a polypeptide encoded by an allelic variant of a gene.

Catalytic domain: The term "catalytic domain" means the region of an enzyme containing the catalytic machinery of the enzyme.

cDNA: The term "cDNA" means a DNA molecule that can be prepared by reverse transcription from a mature, spliced, mRNA molecule obtained from a eukaryotic or prokaryotic cell. cDNA lacks intron sequences that may be present in the corresponding genomic DNA. The initial, primary RNA transcript is a precursor to mRNA that is processed through a series of steps, including splicing, before appearing as mature spliced mRNA.

Cleaning or Detergent Application: the term "cleaning or detergent application" means applying the endoglucanase of the application in any composition for the purpose of cleaning or washing, by hand, machine or automated, a hard surface or a textile.

Cleaning or Detergent Composition: the term "cleaning or detergent composition" refers to compositions that find use in the removal of undesired compounds from items to be cleaned, such as textiles, dishes, and hard surfaces. The terms encompass any materials/compounds selected for the particular type of cleaning composition desired and the form of the product (e.g., liquid, gel, powder, granulate, paste, or spray compositions) and includes, but is not limited to, detergent compositions (e.g., liquid and/or solid laundry detergents and fine fabric detergents; hard surface cleaning formulations, such as for glass, wood, ceramic and metal counter tops and windows; carpet cleaners; oven cleaners; fabric fresheners; fabric softeners; and textile and laundry pre-spotters, as well as dish wash detergents). In addition to the endoglucanase, the detergent formulation may contain one or more additional enzymes (such as proteases, amylases, lipases, cutinases, cellulases, endoglucanases, xyloglucanases, pectinases, pectin lyases, xanthanases, peroxidaes, haloperoxygenases, catalases and mannanases, or any mixture thereof), and/or components such as surfactants, builders, chelators or chelating agents, bleach system or bleach components, polymers, fabric conditioners, foam boosters, suds suppressors, dyes, perfume, tannish inhibitors, optical brighteners, bactericides, fungicides, soil suspending agents, anti corrosion agents, enzyme inhibitors or stabilizers, enzyme activators, transferase(s), hydrolytic enzymes, oxido reductases, bluing agents and fluorescent dyes, antioxidants, and solubilizers.

Coding sequence: The term "coding sequence" means a polynucleotide, which directly specifies the amino acid sequence of a polypeptide. The boundaries of the coding sequence are generally determined by an open reading frame, which begins with a start codon such as ATG, GTG, or TTG and ends with a stop codon such as TAA, TAG, or TGA. The coding sequence may be a genomic DNA, cDNA, synthetic DNA, or a combination thereof.

Colour clarification: During washing and wearing loose or broken fibers can accumulate on the surface of the fabrics. One consequence can be that the colours of the fabric appear less bright or less intense because of the surface contaminations. Removal of the loose or broken fibers from the textile will partly restore the original colours and looks of the textile. By the term "colour clarification", as used herein, is meant the partial restoration of the initial colours of textile.

Control sequences: The term "control sequences" means nucleic acid sequences necessary for expression of a polynucleotide encoding a mature polypeptide of the present invention. Each control sequence may be native (i.e., from the same gene) or foreign (i.e., from a different gene) to the polynucleotide encoding the polypeptide or native or foreign to each other. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the polynucleotide encoding a polypeptide.

Degrading xanthan gum: The term "degrading xanthan gum" is defined herein as the depolymerization, degradation or breaking down of xanthan gum into smaller components. The degradation of xanthan gum can either be the removal of one or more side chain saccharides, the cutting of the backbone of xanthan gum into smaller components or the removal of one or more side chain saccharides and the cutting of the backbone of xanthan gum into smaller components. The degradation of xanthan gum can preferably be measured using the viscosity reduction method as described in example 6. Alternatively, the degradation of xanthan gum can be measured using the reducing ends method as described in example 6 or the colourmetric assay as described in examples 25 and 26.

Delta remission value (ΔRem): The terms "Delta remission" or "Delta remission value" are defined herein as the result of a reflectance or remission measurement at 460 nm. The swatch is measured with one swatch of similar colour as background, preferably a swatch from a repetition wash. A swatch representing each swatch type is measured before wash. The Delta remission is the remission value of the washed swatch minus the remission value of the unwashed swatch.

Delta enzyme performance value (ΔRem enzyme value): The term "Delta enzyme remission value" is defined herein as the result of a reflectance or remission measurement at 460 nm. The swatch is measured with one swatch of similar colour as background, preferably a swatch from a repetition wash. A swatch representing each swatch type is measured before wash. The Delta remission is the remission value of the swatch washed in detergent with an enzyme present minus the remission value of a similar swatch washed in a detergent without enzyme present.

Delta enzyme intensity value (ΔInt enzyme value): The terms "Delta enzyme intensity" or "Delta enzyme intensity value" are defined herein as the result of an enzyme intensity value as defined in AMSA assay. The Delta intensity is the intensity value of the swatch area washed in detergent with an enzyme present minus the intensity value of the swatch area washed in detergent without enzyme present Detergent component: the term "detergent component" is defined herein to mean the types of chemicals which can be used in detergent compositions. Examples of detergent components are surfactants, hydrotropes, builders, co-builders, chelators or chelating agents, bleaching system or bleach components, polymers, fabric hueing agents, fabric conditioners, foam boosters, suds suppressors, dispersants, dye transfer inhibitors, fluorescent whitening agents, perfume, optical brighteners, bactericides, fungicides, soil suspending agents, soil release polymers, anti-redeposition agents, enzyme inhibitors or stabilizers, enzyme activators, antioxidants, and solubilizers. The detergent composition may comprise of one or more of any type of detergent component.

Detergent Composition: the term "detergent composition" refers to compositions that find use in the removal of undesired compounds from items to be cleaned, such as textiles, dishes, and hard surfaces. The detergent composition may be used to e.g. clean textiles, dishes and hard surfaces for both household cleaning and industrial cleaning. The terms encompass any materials/compounds selected for the particular type of cleaning composition desired and the form of the product (e.g., liquid, gel, powder, granulate, paste, or spray compositions) and includes, but is not limited to, detergent compositions (e.g., liquid and/or solid laundry detergents and fine fabric detergents; hard surface cleaning formulations, such as for glass, wood, ceramic and metal counter tops and windows; carpet cleaners; oven cleaners; fabric fresheners; fabric softeners; and textile and laundry pre-spotters, as well as dish wash detergents). In addition to containing a GH9 endoglucanase of the invention and/or xanthan lyase of the invention, the detergent formulation may contain one or more additional enzymes (such as proteases, amylases, lipases, cutinases, cellulases, endoglucanases, xyloglucanases, pectinases, pectin lyases, xanthanases, peroxidaes, haloperoxygenases, catalases and mannanases, or any mixture thereof), and/or components such as surfactants, builders, chelators or chelating agents, bleach system or bleach components, polymers, fabric conditioners, foam boosters, suds suppressors, dyes, perfume, tannish inhibitors, optical brighteners, bactericides, fungicides, soil suspending agents, anti corrosion agents, enzyme inhibitors or stabilizers, enzyme activators, transferase(s), hydrolytic enzymes, oxido reductases, bluing agents and fluorescent dyes, antioxidants, and solubilizers.

Dish wash: The term "dish wash" refers to all forms of washing dishes, e.g. by hand or automatic dish wash. Washing dishes includes, but is not limited to, the cleaning of all forms of crockery such as plates, cups, glasses, bowls, all forms of cutlery such as spoons, knives, forks and serving utensils as well as ceramics, plastics, metals, china, glass and acrylics.

Dish washing composition: The term "dish washing composition" refers to all forms of compositions for cleaning hard surfaces. The present invention is not restricted to any particular type of dish wash composition or any particular detergent.

Endoglucanase: The term "endoglucanase" means an endo-1,4-(1,3;1,4)-beta-D-glucan 4-glucanohydrolase (E.C. 3.2.1.4) that catalyzes endohydrolysis of 1,4-beta-D-glycosidic linkages in cellulose, cellulose derivatives (such as carboxymethyl cellulose and hydroxyethyl cellulose), lichenin, beta-1,4 bonds in mixed beta-1,3 glucans such as cereal beta-D-glucans, xyloglucans, xanthans and other plant material containing cellulosic components. Endoglucanase activity can be determined by measuring reduction in substrate viscosity or increase in reducing ends determined by a reducing sugar assay (Zhang et al., 2006, *Biotechnology Advances* 24: 452-481). For purposes of the present invention, endoglucanase activity is determined using carboxymethyl cellulose (CMC) as substrate according to the procedure of Ghose, 1987, *Pure and Appl. Chem.* 59: 257-268, at pH 5, 40° C.

Enzyme Detergency benefit: The term "enzyme detergency benefit" is defined herein as the advantageous effect an enzyme may add to a detergent compared to the same detergent without the enzyme. Important detergency benefits which can be provided by enzymes are stain removal with no or very little visible soils after washing and or cleaning, prevention or reduction of redeposition of soils released in the washing process an effect that also is termed anti-redeposition, restoring fully or partly the whiteness of textiles, which originally were white but after repeated use and wash have obtained a greyish or yellowish appearance an effect that also is termed whitening. Textile care benefits, which are not directly related to catalytic stain removal or prevention of redeposition of soils are also important for enzyme detergency benefits. Examples of such textile care benefits are prevention or reduction of dye transfer from one fabric to another fabric or another part of the same fabric an effect that is also termed dye transfer inhibition or anti-backstaining, removal of protruding or broken fibers from a fabric surface to decrease pilling tendencies or remove already existing pills or fuzz an effect that also is termed anti-pilling, improvement of the fabric-softness, colour clarification of the fabric and removal of particulate soils which are trapped in the fibers of the fabric or garment. Enzymatic bleaching is a further enzyme detergency benefit where the catalytic activity generally is used to catalyze the formation of bleaching component such as hydrogen peroxide or other peroxides.

Expression: The term "expression" includes any step involved in the production of a polypeptide including, but not limited to, transcription, post-transcriptional modification, translation, post-translational modification, and secretion.

Expression vector: The term "expression vector" means a linear or circular DNA molecule that comprises a polynucleotide encoding a polypeptide and is operably linked to control sequences that provide for its expression.

Fragment: The term "fragment" means a polypeptide or a catalytic domain having one or more (e.g., several) amino acids absent from the amino and/or carboxyl terminus of a mature polypeptide or domain; wherein the fragment has xanthan degrading activity such as activity on xanthan gum pretreated with xanthan lyase or xanthan lyase activity GH9 endoglucanases having activity on xanthan gum pretreated with xanthan lyase: The term "GH9 endoglucanases having activity on xanthan gum pretreated with xanthan lyase" or an "endoglucanases having activity on xanthan gum pretreated with xanthan lyase and belonging to the GH9 class of glycosyl hydrioases" is defined as a polypeptide comprising a domain belonging to the GH9 class of glycosyl hydrolases, and having significant activity on xanthan gum pretreated with xanthan lyase. In one aspect of the invention a GH9 endoglucanases having activity on xanthan gum pretreated with xanthan lyase may be a polypeptide having a sequence selected among SEQ ID NO: 2, SEQ ID NO: 10, SEQ ID NO: 12, SEQ ID NO: 14, SEQ ID NO: 48, SEQ ID NO: 52, SEQ ID NO: 56, SEQ ID NO: 82, SEQ ID NO: 86, SEQ ID NO: 90, SEQ ID NO: 94, SEQ ID NO: 98, SEQ ID NO: 102, SEQ ID NO: 130, SEQ ID NO: 134 and SEQ ID NO: 138. In a particular the GH9 endoglucanase having activity on xanthan gum pretreated with xanthan lyase has higher specificity of xanthan gum pretreated with xanthan lyase the specific activity on CMC (carboxymethylcellulose) which is known as an excellent substrate for endoglucanases. Activity on xanthan gum pretreated with xanthan lyase can be determined as disclosed in Example 8 below.

Hard surface cleaning: The term "Hard surface cleaning" is defined herein as cleaning of hard surfaces wherein hard surfaces may include floors, tables, walls, roofs etc. as well as surfaces of hard objects such as cars (car wash) and dishes (dish wash). Dish washing includes but are not limited to cleaning of plates, cups, glasses, bowls, and cutlery such as spoons, knives, forks, serving utensils, ceramics, plastics, metals, china, glass and acrylics.

Host cell: The term "host cell" means any cell type that is susceptible to transformation, transfection, transduction, or the like with a nucleic acid construct or expression vector comprising a polynucleotide of the present invention. The term "host cell" encompasses any progeny of a parent cell that is not identical to the parent cell due to mutations that occur during replication.

Improved wash performance: The term "improved wash performance" is defined herein as a (variant) enzyme (also a blend of enzymes, not necessarily only variants but also backbones, and in combination with certain cleaning composition etc.) displaying an alteration of the wash performance of a protease variant relative to the wash performance of the parent protease variant e.g. by increased stain removal. The term "wash performance" includes wash performance in laundry but also e.g. in dish wash.

Isolated: The term "isolated" means a substance in a form or environment that does not occur in nature. Non-limiting examples of isolated substances include (1) any non-naturally occurring substance, (2) any substance including, but not limited to, any enzyme, variant, nucleic acid, protein, peptide or cofactor, that is at least partially removed from one or more or all of the naturally occurring constituents with which it is associated in nature; (3) any substance modified by the hand of man relative to that substance found in nature; or (4) any substance modified by increasing the amount of the substance relative to other components with which it is naturally associated (e.g., multiple copies of a gene encoding the substance; use of a stronger promoter than the promoter naturally associated with the gene encoding the substance). An isolated substance may be present in a fermentation broth sample.

Laundering: The term "laundering" relates to both household laundering and industrial laundering and means the process of treating textiles with a solution containing a cleaning or detergent composition of the present invention. The laundering process can for example be carried out using e.g. a household or an industrial washing machine or can be carried out by hand.

Mature polypeptide: The term "mature polypeptide" means a polypeptide in its final form following translation and any post-translational modifications, such as N-terminal processing, C-terminal truncation, glycosylation, phosphorylation, etc. In one aspect, the mature polypeptide is amino acids 1 to 1055 of SEQ ID NO: 2 based on the SignalP program (Nielsen et al., 1997, *Protein Engineering* 10: 1-6) that predicts amino acids −38 to −1 of SEQ ID NO: 2 are a signal peptide. In another aspect, the mature polypeptide is amino acids 1 to 918 of SEQ ID NO: 10 based on the SignalP program that predicts amino acids −33 to −1 of SEQ ID NO: 10 are a signal peptide. In a further aspect, the mature polypeptide is amino acids 1 to 916 of SEQ ID NO: 12 based on the SignalP program that predicts amino acids −32 to −1 of SEQ ID NO: 12 are a signal peptide. In one aspect, the mature polypeptide is amino acids 1 to 918 of SEQ ID NO: 14 based on the SignalP program that predicts amino acids −33 to −1 of SEQ ID NO: 14 are a signal peptide. In another aspect, the mature polypeptide is amino acids 1 to 1007 of SEQ ID NO: 48 based on the SignalP program that predicts amino acids −36 to −1 of SEQ ID NO: 48 are a signal peptide. In a further aspect, the mature polypeptide is amino acids 1 to 915 of SEQ ID NO: 52 based on the SignalP program that predicts amino acids −36 to −1 of SEQ ID NO: 52 are a signal peptide. In an additional aspect, the mature polypeptide is amino acids 1 to 1056 of SEQ ID NO: 56 based on the SignalP program that predicts amino acids −38 to −1 of SEQ ID NO: 56 are a signal peptide.

In one aspect, the mature polypeptide is amino acids 1 to 1371 of SEQ ID NO: 82 based on the SignalP program that predicts amino acids −37 to −1 of SEQ ID NO: 82 are a signal peptide. In another aspect, the mature polypeptide is amino acids 1 to 1203 of SEQ ID NO: 86 based on the SignalP program that predicts amino acids −37 to −1 of SEQ ID NO: 86 are a signal peptide. In a further aspect, the mature polypeptide is amino acids 1 to 1379 of SEQ ID NO: 90 based on the SignalP program that predicts amino acids −37 to −1 of SEQ ID NO: 90 are a signal peptide. In an additional aspect, the mature polypeptide is amino acids 1 to 1371 of SEQ ID NO: 94 based on the SignalP program that predicts amino acids −37 to −1 of SEQ ID NO: 94 are a signal peptide. In one aspect, the mature polypeptide is amino acids 1 to 1372 of SEQ ID NO: 98 based on the SignalP program that predicts amino acids −37 to −1 of SEQ ID NO: 98 are a signal peptide. In another aspect, the mature polypeptide is amino acids 1 to 922 of SEQ ID NO: 102 based on the SignalP program that predicts amino acids −32 to −1 of SEQ ID NO: 102 are a signal peptide. In a further aspect, the mature polypeptide is amino acids 1 to 916 of SEQ ID NO: 130 based on the SignalP program that predicts amino acids −36 to −1 of SEQ ID NO: 130 are a signal peptide. In an additional aspect, the mature polypeptide is amino acids 1 to 1373 of SEQ ID NO: 134 based on the SignalP program that predicts amino acids −37 to −1 of SEQ ID NO: 134 are a signal peptide. In an additional aspect, the mature polypeptide is amino acids 1 to 1204 of SEQ ID NO: 138 based on the SignalP program that predicts amino acids −37 to −1 of SEQ ID NO: 138 are a signal peptide.

In one aspect, the mature polypeptide is amino acids 1 to 760 of SEQ ID NO: 4 based on the SignalP program that predicts amino acids −31 to −1 of SEQ ID NO: 4 are a signal peptide. In another aspect, the mature polypeptide is amino acids 1 to 1043 of SEQ ID NO: 46 based on the SignalP program that predicts amino acids −31 to −1 of SEQ ID NO: 46 are a signal peptide. In a further aspect, the mature polypeptide is amino acids 1 to 896 of SEQ ID NO: 60 based on the SignalP program that predicts amino acids −41 to −1 of SEQ ID NO: 60 are a signal peptide. In one aspect, the mature polypeptide is amino acids 1 to 1038 of SEQ ID NO: 64 based on the SignalP program that predicts amino acids −24 to −1 of SEQ ID NO: 64 are a signal peptide.

In one aspect, the mature polypeptide is amino acids 1 to 901 of SEQ ID NO: 106 based on the SignalP program that predicts amino acids −32 to −1 of SEQ ID NO: 106 are a signal peptide. In another aspect, the mature polypeptide is amino acids 1 to 899 of SEQ ID NO: 110 based on the SignalP program that predicts amino acids −32 to −1 of SEQ ID NO: 110 are a signal peptide. In a further aspect, the mature polypeptide is amino acids 1 to 897 of SEQ ID NO: 114 based on the SignalP program that predicts amino acids −61 to −1 of SEQ ID NO: 114 are a signal peptide. In an additional aspect, the mature polypeptide is amino acids 1 to 933 of SEQ ID NO: 118 based on the SignalP program that predicts amino acids −27 to −1 of SEQ ID NO: 118 are a signal peptide. In one aspect, the mature polypeptide is amino acids 1 to 1049 of SEQ ID NO: 122 based on the SignalP program that predicts amino acids −42 to −1 of SEQ ID NO: 122 are a signal peptide. In another aspect, the mature polypeptide is amino acids 1 to 900 of SEQ ID NO: 126 based on the SignalP program that predicts amino acids −33 to −1 of SEQ ID NO: 126 are a signal peptide.

It is known in the art that a host cell may produce a mixture of two of more different mature polypeptides (i.e., with a different C-terminal and/or N-terminal amino acid) expressed by the same polynucleotide. It is also known in the art that different host cells process polypeptides differently, and thus, one host cell expressing a polynucleotide may produce a different mature polypeptide (e.g., having a different C-terminal and/or N-terminal amino acid) as compared to another host cell expressing the same polynucleotide.

Mature polypeptide coding sequence: The term "mature polypeptide coding sequence" means a polynucleotide that encodes a mature polypeptide having enzymatic activity such as activity on xanthan gum pretreated with xanthan lyase or xanthan lyase activity. In one aspect, the mature polypeptide coding sequence is nucleotides 115 to 3279 of SEQ ID NO: 1 based on the SignalP program (Nielsen et al., 1997, supra) that predicts nucleotides 1 to 114 of SEQ ID NO: 1 encode a signal peptide. In another aspect, the mature polypeptide coding sequence is nucleotides 94 to 2373 of SEQ ID NO: 3 based on the SignalP program that predicts nucleotides 1 to 93 of SEQ ID NO: 3 encode a signal peptide. In a further aspect, the mature polypeptide coding sequence is nucleotides 600 to 3353 of SEQ ID NO: 9 based on the SignalP program that predicts nucleotides 501 to 599 of SEQ ID NO: 9 encode a signal peptide. In one aspect, the mature polypeptide coding sequence is nucleotides 174 to 2921 of SEQ ID NO: 11 based on the SignalP program that predicts nucleotides 78 to 173 of SEQ ID NO: 11 encode a signal peptide. In another aspect, the mature polypeptide coding sequence is nucleotides 200 to 2953 of SEQ ID NO: 13 based on the SignalP program that predicts nucleotides 101 to 199 of SEQ ID NO: 13 encode a signal peptide. In a further aspect, the mature polypeptide coding sequence is nucleotides 209 to 3337 of SEQ ID NO: 45 based on the SignalP program that predicts nucleotides 116 to 208 of SEQ ID NO: 45 encode a signal peptide. In one aspect, the mature polypeptide coding sequence is nucleotides 109 to 3129 of SEQ ID NO: 47 based on the SignalP program that predicts nucleotides 1 to 108 of SEQ ID NO: 47 encode a signal peptide. In another aspect, the mature polypeptide coding sequence is nucleotides 109 to 2853 of SEQ ID NO: 51 based on the SignalP program that predicts nucleotides 1 to 108 of SEQ ID NO: 51 encode a signal peptide. In a further aspect, the mature polypeptide coding sequence is nucleotides 115 to 3282 of SEQ ID NO: 55 based on the SignalP program that predicts nucleotides 1 to 114 of SEQ ID NO: 55 encode a signal peptide. In an additional aspect, the mature polypeptide coding sequence is nucleotides 124 to 2811 of SEQ ID NO: 59 based on the SignalP program that predicts nucleotides 1 to 123 of SEQ ID NO: 59 encode a signal peptide. In one aspect, the mature polypeptide coding sequence is nucleotides 73 to 3195 of SEQ ID NO: 63 based on the SignalP program that predicts nucleotides 1 to 72 of SEQ ID NO: 63 encode a signal peptide.

In one aspect, the mature polypeptide coding sequence is nucleotides 112 to 4224 of SEQ ID NO: 81 based on the SignalP program that predicts nucleotides 1 to 111 of SEQ ID NO: 81 encode a signal peptide. In another aspect, the mature polypeptide coding sequence is nucleotides 112 to 3720 of SEQ ID NO: 85 based on the SignalP program that predicts nucleotides 1 to 111 of SEQ ID NO: 85 encode a signal peptide. In a further aspect, the mature polypeptide coding sequence is nucleotides 112 to 4248 of SEQ ID NO: 89 based on the SignalP program that predicts nucleotides 1 to 111 of SEQ ID NO: 89 encode a signal peptide. In an additional aspect, the mature polypeptide coding sequence is nucleotides 112 to 4224 of SEQ ID NO: 93 based on the SignalP program that predicts nucleotides 1 to 111 of SEQ ID NO: 93 encode a signal peptide. In one aspect, the mature polypeptide coding sequence is nucleotides 112 to 4227 of SEQ ID NO: 97 based on the SignalP program that predicts nucleotides 1 to 111 of SEQ ID NO: 97 encode a signal peptide. In another aspect, the mature polypeptide coding sequence is nucleotides 76 to 2841 of SEQ ID NO: 101 based on the SignalP program that predicts nucleotides 1 to 75 of SEQ ID NO: 101 encode a signal peptide. In a further aspect, the mature polypeptide coding sequence is nucleotides 97 to 2799 of SEQ ID NO: 105 based on the SignalP program that predicts nucleotides 1 to 96 of SEQ ID NO: 105 encode a signal peptide. In an additional aspect, the mature polypeptide coding sequence is nucleotides 97 to 2793 of SEQ ID NO: 109 based on the SignalP program that predicts nucleotides 1 to 96 of SEQ ID NO: 109 encode a signal peptide. In one aspect, the mature polypeptide coding sequence is nucleotides 184 to 2874 of SEQ ID NO: 113 based on the SignalP program that predicts nucleotides 1 to 183 of SEQ ID NO: 113 encode a signal peptide. In another aspect, the mature polypeptide coding sequence is nucleotides 82 to 2880 of SEQ ID NO: 117 based on the SignalP program that predicts nucleotides 1 to 81 of SEQ ID NO: 117 encode a signal peptide. In a further aspect, the mature polypeptide coding sequence is nucleotides 127 to 3273 of SEQ ID NO: 121 based on the SignalP program that predicts nucleotides 1 to 126 of SEQ ID NO: 121 encode a signal peptide. In an additional aspect, the mature polypeptide coding sequence is nucleotides 100 to 2799 of SEQ ID NO: 125 based on the SignalP program that predicts nucleotides 1 to 99 of SEQ ID NO: 125 encode a signal peptide. In one aspect, the mature polypeptide coding sequence is nucleotides 97 to 2844 of SEQ ID NO: 129 based on the SignalP program that predicts nucleotides 1 to 96 of SEQ ID NO: 129 encode a signal peptide. In another aspect, the mature polypeptide coding sequence is nucleotides 112 to 4230 of SEQ ID NO: 133 based on the SignalP program that predicts nucleotides 1 to 111 of SEQ ID NO: 133 encode a signal peptide. In a further aspect, the mature polypeptide coding sequence is nucleotides 112 to 3723 of SEQ ID NO: 137 based on the SignalP program that predicts nucleotides 1 to 111 of SEQ ID NO: 137 encode a signal peptide.

Nucleic acid construct: The term "nucleic acid construct" means a nucleic acid molecule, either single- or double-stranded, which is isolated from a naturally occurring gene or is modified to contain segments of nucleic acids in a manner that would not otherwise exist in nature or which is synthetic, which comprises one or more control sequences.

Operably linked: The term "operably linked" means a configuration in which a control sequence is placed at an appropriate position relative to the coding sequence of a polynucleotide such that the control sequence directs expression of the coding sequence.

Sequence identity: The relatedness between two amino acid sequences or between two nucleotide sequences is described by the parameter "sequence identity". For purposes of the present invention, the sequence identity between two amino acid sequences is determined using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 5.0.0 or later. The parameters used are gap open penalty of 10, gap extension penalty of 0.5, and the EBLOSUM62 (EMBOSS version of BLOSUM62) substitution matrix. The output of Needle labeled "longest identity" (obtained using the -nobrief option) is used as the percent identity and is calculated as follows:

(Identical Residues×100)/(Length of Alignment−
Total Number of Gaps in Alignment)

For purposes of the present invention, the sequence identity between two deoxyribonucleotide sequences is determined using the Needleman-Wunsch algorithm (Needleman and Wunsch, 1970, supra) as implemented in the Needle program of the EMBOSS package (EMBOSS: The European Molecular Biology Open Software Suite, Rice et al., 2000, supra), preferably version 5.0.0 or later. The parameters used are gap open penalty of 10, gap extension penalty of 0.5, and the EDNAFULL (EMBOSS version of NCBI NUC4.4) substitution matrix. The output of Needle labeled "longest identity" (obtained using the -nobrief option) is used as the percent identity and is calculated as follows:

(Identical Deoxyribonucleotides×100)/(Length of Alignment−Total Number of Gaps in Alignment)

Stringency conditions: The different stringency conditions are defined as follows.

The term "very low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 2×SSC, 0.2% SDS at 45° C.

The term "low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 2×SSC, 0.2% SDS at 50° C.

The term "medium stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 2×SSC, 0.2% SDS at 55° C.

The term "medium-high stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 2×SSC, 0.2% SDS at 60° C.

The term "high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 2×SSC, 0.2% SDS at 65° C.

The term "very high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 2×SSC, 0.2% SDS at 70° C.

Subsequence: The term "subsequence" means a polynucleotide having one or more (e.g., several) nucleotides absent from the 5' and/or 3' end of a mature polypeptide coding sequence; wherein the subsequence encodes a fragment having enzymatic activity, such as activity on xanthan gum pretreated with xanthan lyase or xanthan lyase activity.

Textile: The term "textile" means any textile material including yarns, yarn intermediates, fibers, non-woven materials, natural materials, synthetic materials, and any other textile material, fabrics made of these materials and products made from fabrics (e.g., garments and other articles). The textile or fabric may be in the form of knits, wovens, denims, non-wovens, felts, yarns, and toweling. The textile may be cellulose based such as natural cellulosics, including cotton, flax/linen, jute, ramie, sisal or coir or manmade cellulosics (e.g. originating from wood pulp) including viscose/rayon, ramie, cellulose acetate fibers (tricell), lyocell or blends thereof. The textile or fabric may also be non-cellulose based such as natural polyamides including wool, camel, cashmere, mohair, rabbit and silk or synthetic polymer such as nylon, aramid, polyester, acrylic, polypropylene and spandex/elastane, or blends thereof as well as blend of cellulose based and non-cellulose based fibers. Examples of blends are blends of cotton and/or rayon/viscose with one or more companion material such as wool, synthetic fibers (e.g. polyamide fibers, acrylic fibers, polyester fibers, polyvinyl alcohol fibers, polyvinyl chloride fibers, polyurethane fibers, polyurea fibers, aramid fibers), and cellulose-containing fibers (e.g. rayon/viscose, ramie, flax/linen, jute, cellulose acetate fibers, lyocell). Fabric may be conventional washable laundry, for example stained household laundry. When the term fabric or garment is used it is intended to include the broader term textiles as well.

Textile care benefit: "Textile care benefits", which are not directly related to catalytic stain removal or prevention of redeposition of soils, are also important for enzyme detergency benefits. Examples of such textile care benefits are prevention or reduction of dye transfer from one textile to another textile or another part of the same textile an effect that is also termed dye transfer inhibition or anti-backstaining, removal of protruding or broken fibers from a textile surface to decrease pilling tendencies or remove already existing pills or fuzz an effect that also is termed anti-pilling, improvement of the textile-softness, colour clarification of the textile and removal of particulate soils which are trapped in the fibers of the textile. Enzymatic bleaching is a further enzyme detergency benefit where the catalytic activity generally is used to catalyze the formation of bleaching component such as hydrogen peroxide or other peroxides or other bleaching species.

Variant: The term "variant" means an GH9 endoglucanase having activity on xanthan gum pretreated with xanthan lyase e., a substitution, insertion, and/or deletion, at one or more (e.g., several) positions. A substitution means replacement of the amino acid occupying a position with a different amino acid; a deletion means removal of the amino acid occupying a position; and an insertion means adding one or more (e.g. several) amino acids e.g. 1-5 amino acids adjacent to and immediately following the amino acid occupying a position.

In one embodiment the term "variant" means a polypeptide having xanthan lyase activity comprising an alteration, i.e., a substitution, insertion, and/or deletion, at one or more (e.g., several) positions. A substitution means replacement of the amino acid occupying a position with a different amino acid; a deletion means removal of the amino acid occupying a position; and an insertion means adding one or more (e.g.

several) amino acids e.g. 1-5 amino acids adjacent to and immediately following the amino acid occupying a position.

In another embodiment the term "variant" means a GH9 endoglucanases having activity on xanthan gum pretreated with xanthan lyase comprising an alteration, i.e., a substitution, insertion, and/or deletion, at one or more (e.g., several) positions. A substitution means replacement of the amino acid occupying a position with a different amino acid; a deletion means removal of the amino acid occupying a position; and an insertion means adding one or more (e.g. several) amino acids e.g. 1-5 amino acids adjacent to and immediately following the amino acid occupying a position.

Wash performance: The term "wash performance" is used as an enzyme's ability to remove stains present on the object to be cleaned during e.g. wash or hard surface cleaning. The improvement in the wash performance may be quantified by calculating the so-called intensity value (Int) as defined in 'Automatic Mechanical Stress Assay (AMSA) for laundry' herein or the remission value (Rem) as defined herein. See also the wash performance test in Examples 9, 18, 19, 28, 31 and 32 herein.

Whiteness: The term "Whiteness" is defined herein as a broad term with different meanings in different regions and for different customers. Loss of whiteness can e.g. be due to greying, yellowing, or removal of optical brighteners/hueing agents. Greying and yellowing can be due to soil redeposition, body soils, colouring from e.g. iron and copper ions or dye transfer. Whiteness might include one or several issues from the list below: Colorant or dye effects; Incomplete stain removal (e.g. body soils, sebum etc.); Re-deposition (greying, yellowing or other discolorations of the object) (removed soils re-associates with other part of textile, soiled or unsoiled); Chemical changes in textile during application; and Clarification or brightening of colours.

Xanthan Lyase: The term "xanthan lyase" is defined herein as an enzyme that cleaves the β-D-mannosyl-β-D-1, 4-glucuronosyl bonds in xanthan gum (EC 4.2.2.12). For purposes of the present invention, xanthan lyase activity is determined according to the procedure described in the Examples. In one aspect, the polypeptides of the present invention have at least 20%, e.g., at least 40%, at least 50%, at least 60%, at least 70%, at least 80%, at least 90%, at least 95%, or at least 100% of the xanthan lyase activity of the mature polypeptide of SEQ ID NO: 4, SEQ ID NO: 46, SEQ ID NO: 60 or SEQ ID NO: 64. Xanthan lyase activity may be determined as described in the 'Xanthan lyase activity assay' as described in the Example section.

DETAILED DESCRIPTION OF THE INVENTION

The present invention provides polypeptides having xanthan lyase activity and to GH9 endoglucanases having activity on xanthan gum pretreated with xanthan lyase and polynucleotides encoding the polypeptides. The GH9 endoglucanase class of enzymes has not previously been shown to degrade xanthan. In addition, the combination of xanthan lyase and an GH9 endoglucanases having activity on xanthan gum pretreated with xanthan lyase of the invention shows a synergistic improved wash performance over using xanthan lyase or GH9 endoglucanases having activity on xanthan gum pretreated with xanthan lyase alone.

GH9 Endoglucanases Having Activity on Xanthan Gum Pretreated with Xanthan Lyase and Polypeptides Having Xanthan Lyase Activity In an embodiment, the present invention relates to isolated GH9 endoglucanases having activity on xanthan gum pretreated with xanthan lyase and having a sequence identity to the mature polypeptide of SEQ ID NO: 2 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%, which have xanthan degrading activity.

In an embodiment, the present invention relates to isolated GH9 endoglucanases having activity on xanthan gum pretreated with xanthan lyase and having a sequence identity to the mature polypeptide of SEQ ID NO: 2 of at least 80%, e.g., at least 85%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 2. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 2.

A polypeptide of the present invention preferably comprises or consists of the amino acid sequence of SEQ ID NO: 2 or an allelic variant thereof; or is a fragment thereof having endoglucanase activity and activity on xanthan gum pretreated with xanthan lyase. In another aspect, the polypeptide comprises or consists of the mature polypeptide of SEQ ID NO: 2. In another aspect, the polypeptide comprises or consists of amino acids 1 to 1055 of SEQ ID NO: 2.

In another embodiment, the present invention relates to isolated GH9 endoglucanases having activity on xanthan gum pretreated with xanthan lyase and having a sequence identity to the mature polypeptide of SEQ ID NO: 10 of at least 85%, e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%, which have xanthan degrading activity.

In an embodiment, the present invention relates to isolated GH9 endoglucanases having activity on xanthan gum pretreated with xanthan lyase and having a sequence identity to the mature polypeptide of SEQ ID NO: 10 of at least 80%, e.g., at least 85%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 10. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 10.

A polypeptide of the present invention preferably comprises or consists of the amino acid sequence of SEQ ID NO: 10 or an allelic variant thereof; or is a fragment thereof having endoglucanase activity and having activity on xanthan gum pretreated with xanthan lyase. In another aspect, the polypeptide comprises or consists of the mature polypeptide of SEQ ID NO: 10. In another aspect, the polypeptide comprises or consists of amino acids 1 to 918 of SEQ ID NO: 10.

In a further embodiment, the present invention relates to isolated GH9 endoglucanases having activity on xanthan gum pretreated with xanthan lyase and having a sequence identity to the mature polypeptide of SEQ ID NO: 12 of at least 90%, e.g., at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 12. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 12.

A polypeptide of the present invention preferably comprises or consists of the amino acid sequence of SEQ ID NO: 12 or an allelic variant thereof; or is a fragment thereof having activity on xanthan gum pretreated with xanthan lyase. In another aspect, the polypeptide comprises or consists of the mature polypeptide of SEQ ID NO: 12. In another aspect, the polypeptide comprises or consists of amino acids 1 to 916 of SEQ ID NO: 12.

In a further embodiment, the present invention relates to isolated GH9 endoglucanases having activity on xanthan gum pretreated with xanthan lyase and having a sequence identity to the mature polypeptide of SEQ ID NO: 14 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 14. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 14.

A polypeptide of the present invention preferably comprises or consists of the amino acid sequence of SEQ ID NO: 14 or an allelic variant thereof; or is a fragment thereof having activity on xanthan gum pretreated with xanthan lyase. In another aspect, the polypeptide comprises or consists of the mature polypeptide of SEQ ID NO: 14. In another aspect, the polypeptide comprises or consists of amino acids 1 to 918 of SEQ ID NO: 14.

In a further embodiment, the present invention relates to isolated GH9 endoglucanases having activity on xanthan gum pretreated with xanthan lyase and having a sequence identity to the mature polypeptide of SEQ ID NO: 48 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 48. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 48.

A polypeptide of the present invention preferably comprises or consists of the amino acid sequence of SEQ ID NO: 48 or an allelic variant thereof; or is a fragment thereof having activity on xanthan gum pretreated with xanthan lyase. In another aspect, the polypeptide comprises or consists of the mature polypeptide of SEQ ID NO: 48. In another aspect, the polypeptide comprises or consists of amino acids 1 to 1007 of SEQ ID NO: 48.

In a further embodiment, the present invention relates to isolated GH9 endoglucanases having activity on xanthan gum pretreated with xanthan lyase and having a sequence identity to the mature polypeptide of SEQ ID NO: 52 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 52. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 52.

A polypeptide of the present invention preferably comprises or consists of the amino acid sequence of SEQ ID NO: 52 or an allelic variant thereof; or is a fragment thereof having activity on xanthan gum pretreated with xanthan lyase. In another aspect, the polypeptide comprises or consists of the mature polypeptide of SEQ ID NO: 52. In another aspect, the polypeptide comprises or consists of amino acids 1 to 915 of SEQ ID NO: 52.

In a further embodiment, the present invention relates to isolated GH9 endoglucanases having activity on xanthan gum pretreated with xanthan lyase and having a sequence identity to the mature polypeptide of SEQ ID NO: 56 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 56. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 56.

A polypeptide of the present invention preferably comprises or consists of the amino acid sequence of SEQ ID NO: 56 or an allelic variant thereof; or is a fragment thereof having activity on xanthan gum pretreated with xanthan lyase. In another aspect, the polypeptide comprises or consists of the mature polypeptide of SEQ ID NO: 56. In another aspect, the polypeptide comprises or consists of amino acids 1 to 1056 of SEQ ID NO: 56.

In a further embodiment, the present invention relates to isolated GH9 endoglucanases having activity on xanthan gum pretreated with xanthan lyase and having a sequence identity to the mature polypeptide of SEQ ID NO: 82 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 82. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 82.

A polypeptide of the present invention preferably comprises or consists of the amino acid sequence of SEQ ID NO: 82 or an allelic variant thereof; or is a fragment thereof having activity on xanthan gum pretreated with xanthan lyase. In another aspect, the polypeptide comprises or consists of the mature polypeptide of SEQ ID NO: 82. In another aspect, the polypeptide comprises or consists of amino acids 1 to 1371 of SEQ ID NO: 82.

In a further embodiment, the present invention relates to isolated GH9 endoglucanases having activity on xanthan gum pretreated with xanthan lyase and having a sequence identity to the mature polypeptide of SEQ ID NO: 86 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 86. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 86.

A polypeptide of the present invention preferably comprises or consists of the amino acid sequence of SEQ ID NO: 86 or an allelic variant thereof; or is a fragment thereof having activity on xanthan gum pretreated with xanthan lyase. In another aspect, the polypeptide comprises or consists of the mature polypeptide of SEQ ID NO: 86. In another aspect, the polypeptide comprises or consists of amino acids 1 to 1203 of SEQ ID NO: 86.

In a further embodiment, the present invention relates to isolated GH9 endoglucanases having activity on xanthan gum pretreated with xanthan lyase and having a sequence identity to the mature polypeptide of SEQ ID NO: 90 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 90. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 90.

A polypeptide of the present invention preferably comprises or consists of the amino acid sequence of SEQ ID NO: 90 or an allelic variant thereof; or is a fragment thereof having activity on xanthan gum pretreated with xanthan lyase. In another aspect, the polypeptide comprises or consists of the mature polypeptide of SEQ ID NO: 90. In another aspect, the polypeptide comprises or consists of amino acids 1 to 1379 of SEQ ID NO: 90.

In a further embodiment, the present invention relates to isolated GH9 endoglucanases having activity on xanthan gum pretreated with xanthan lyase and having a sequence identity to the mature polypeptide of SEQ ID NO: 94 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 94. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 94.

A polypeptide of the present invention preferably comprises or consists of the amino acid sequence of SEQ ID NO: 94 or an allelic variant thereof; or is a fragment thereof having activity on xanthan gum pretreated with xanthan lyase. In another aspect, the polypeptide comprises or consists of the mature polypeptide of SEQ ID NO: 94. In another aspect, the polypeptide comprises or consists of amino acids 1 to 1371 of SEQ ID NO: 94.

In a further embodiment, the present invention relates to isolated GH9 endoglucanases having activity on xanthan gum pretreated with xanthan lyase and having a sequence identity to the mature polypeptide of SEQ ID NO: 98 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 98. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 98.

A polypeptide of the present invention preferably comprises or consists of the amino acid sequence of SEQ ID NO: 98 or an allelic variant thereof; or is a fragment thereof having activity on xanthan gum pretreated with xanthan lyase. In another aspect, the polypeptide comprises or consists of the mature polypeptide of SEQ ID NO: 98. In another aspect, the polypeptide comprises or consists of amino acids 1 to 1372 of SEQ ID NO: 98.

In a further embodiment, the present invention relates to isolated GH9 endoglucanases having activity on xanthan gum pretreated with xanthan lyase and having a sequence identity to the mature polypeptide of SEQ ID NO: 130 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 130. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 130.

A polypeptide of the present invention preferably comprises or consists of the amino acid sequence of SEQ ID NO: 130 or an allelic variant thereof; or is a fragment thereof having activity on xanthan gum pretreated with xanthan lyase. In another aspect, the polypeptide comprises or consists of the mature polypeptide of SEQ ID NO: 130. In another aspect, the polypeptide comprises or consists of amino acids 1 to 916 of SEQ ID NO: 130.

In a further embodiment, the present invention relates to isolated GH9 endoglucanases having activity on xanthan gum pretreated with xanthan lyase and having a sequence identity to the mature polypeptide of SEQ ID NO: 134 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 134. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 134.

A polypeptide of the present invention preferably comprises or consists of the amino acid sequence of SEQ ID NO: 134 or an allelic variant thereof; or is a fragment thereof having activity on xanthan gum pretreated with xanthan lyase. In another aspect, the polypeptide comprises or consists of the mature polypeptide of SEQ ID NO: 134. In another aspect, the polypeptide comprises or consists of amino acids 1 to 1373 of SEQ ID NO: 134.

In a further embodiment, the present invention relates to isolated GH9 endoglucanases having activity on xanthan gum pretreated with xanthan lyase and having a sequence identity to the mature polypeptide of SEQ ID NO: 138 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 138. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 138.

A polypeptide of the present invention preferably comprises or consists of the amino acid sequence of SEQ ID NO: 138 or an allelic variant thereof; or is a fragment thereof having activity on xanthan gum pretreated with xanthan lyase. In another aspect, the polypeptide comprises or consists of the mature polypeptide of SEQ ID NO: 138. In another aspect, the polypeptide comprises or consists of amino acids 1 to 1204 of SEQ ID NO: 138.

In another embodiment, the present invention relates to an isolated GH9 endoglucanases having activity on xanthan gum pretreated with xanthan lyase encoded by a polynucleotide that hybridizes under medium stringency conditions, medium-high stringency conditions, high stringency conditions, or very high stringency conditions with the mature polypeptide coding sequence of SEQ ID NO: 1, SEQ ID NO: 47, SEQ ID NO: 51, SEQ ID NO: 55, SEQ ID NO: 81, SEQ ID NO: 85, SEQ ID NO: 89, SEQ ID NO: 93, SEQ ID NO: 97, SEQ ID NO: 129, SEQ ID NO: 133, SEQ ID NO: 137, or the full-length complement thereof (Sambrook et al., 1989, *Molecular Cloning, A Laboratory Manual*, 2d edition, Cold Spring Harbor, N.Y.). In a further embodiment, the present invention relates to an isolated GH9 endoglucanases having activity on xanthan gum pretreated with xanthan lyase encoded by a polynucleotide that hybridizes under high stringency conditions, or very high stringency conditions with the mature polypeptide coding sequence of SEQ ID NO: 9, SEQ ID NO: 11, SEQ ID NO: 13 or the full-length complement thereof.

The polynucleotide of SEQ ID NO: 1, SEQ ID NO: 9, SEQ ID NO: 11, SEQ ID NO: 13, SEQ ID NO: 47, SEQ ID NO: 51, SEQ ID NO: 55, SEQ ID NO: 81, SEQ ID NO: 85, SEQ ID NO: 89, SEQ ID NO: 93, SEQ ID NO: 97, SEQ ID NO: 129, SEQ ID NO: 133 or SEQ ID NO: 137, or a subsequence thereof, as well as the polypeptide of SEQ ID NO: 2, SEQ ID NO: 10, SEQ ID NO: 12, SEQ ID NO: 14, SEQ ID NO: 48, SEQ ID NO: 52, SEQ ID NO: 56, SEQ ID NO: 82, SEQ ID NO: 86, SEQ ID NO: 90, SEQ ID NO: 94, SEQ ID NO: 98, SEQ ID NO: 130, SEQ ID NO: 134, SEQ ID NO: 138, or a fragment thereof, may be used to design nucleic acid probes to identify and clone DNA encoding GH9 endoglucanase having activity on xanthan gum pretreated with xanthan lyase from strains of different genera or species according to methods well known in the art. In particular, such probes can be used for hybridization with the genomic DNA or cDNA of a cell of interest, following standard Southern blotting procedures, in order to identify and isolate the corresponding gene therein. Such probes can be considerably shorter than the entire sequence, but should be at least 15, e.g., at least 25, at least 35, or at least 70 nucleotides in length. Preferably, the nucleic acid probe is at least 100 nucleotides in length, e.g., at least 200 nucleotides, at least 300 nucleotides, at least 400 nucleotides, at least 500 nucleotides, at least 600 nucleotides, at least 700 nucleotides, at least 800 nucleotides, or at least 900 nucleotides in length. Both DNA and RNA probes can be used. The probes are typically labelled for detecting the corresponding gene (for example, with $^{32}P$, $^{3}H$, $^{35}S$, biotin, or avidin). Such probes are encompassed by the present invention.

A genomic DNA or cDNA library prepared from such other strains may be screened for DNA that hybridizes with the probes described above and encodes a GH9 endoglucanase having activity on xanthan gum pretreated with xanthan lyase. Genomic or other DNA from such other strains may be separated by agarose or polyacrylamide gel electrophoresis, or other separation techniques. DNA from the libraries or the separated DNA may be transferred to and immobilized on nitrocellulose or other suitable carrier material. In order to identify a clone or DNA that hybridizes with SEQ ID NO: 1, SEQ ID NO: 9, SEQ ID NO: 11, SEQ ID NO: 13, SEQ ID NO: 47, SEQ ID NO: 51, SEQ ID NO: 55, SEQ ID NO: 81, SEQ ID NO: 85, SEQ ID NO: 89, SEQ ID NO: 93, SEQ ID NO: 97, SEQ ID NO: 129, SEQ ID NO: 133 or SEQ ID NO: 137, or a subsequence thereof, the carrier material is used in a Southern blot.

In an embodiment, the present invention relates to isolated polypeptides having xanthan lyase activity and having a sequence identity to the mature polypeptide of SEQ ID NO: 4 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 4. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 4.

A polypeptide of the present invention preferably comprises or consists of the amino acid sequence of SEQ ID NO: 4 or an allelic variant thereof; or is a fragment thereof having xanthan lyase activity. In another aspect, the polypeptide comprises or consists of the mature polypeptide of SEQ ID NO: 4. In another aspect, the polypeptide comprises or consists of amino acids 1 to 760 of SEQ ID NO: 4.

In an embodiment, the present invention relates to isolated polypeptides having xanthan lyase activity and having a sequence identity to the mature polypeptide of SEQ ID NO: 46 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 46. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 46.

A polypeptide of the present invention preferably comprises or consists of the amino acid sequence of SEQ ID NO: 46 or an allelic variant thereof; or is a fragment thereof having xanthan lyase activity. In another aspect, the polypeptide comprises or consists of the mature polypeptide of SEQ ID NO: 46. In another aspect, the polypeptide comprises or consists of amino acids 1 to 1043 of SEQ ID NO: 46.

In an embodiment, the present invention relates to isolated polypeptides having xanthan lyase activity and having a sequence identity to the mature polypeptide of SEQ ID NO: 60 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 60. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 60.

A polypeptide of the present invention preferably comprises or consists of the amino acid sequence of SEQ ID NO: 60 or an allelic variant thereof; or is a fragment thereof having xanthan lyase activity. In another aspect, the polypeptide comprises or consists of the mature polypeptide of SEQ ID NO: 60. In another aspect, the polypeptide comprises or consists of amino acids 1 to 896 of SEQ ID NO: 60.

In an embodiment, the present invention relates to isolated polypeptides having xanthan lyase activity and having a sequence identity to the mature polypeptide of SEQ ID NO: 64 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 64. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 64.

A polypeptide of the present invention preferably comprises or consists of the amino acid sequence of SEQ ID NO: 64 or an allelic variant thereof; or is a fragment thereof having xanthan lyase activity. In another aspect, the polypeptide comprises or consists of the mature polypeptide of SEQ ID NO: 64. In another aspect, the polypeptide comprises or consists of amino acids 1 to 1038 of SEQ ID NO: 64.

In an embodiment, the present invention relates to isolated polypeptides having xanthan lyase activity and having a sequence identity to the mature polypeptide of SEQ ID NO: 106 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 106. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 106.

A polypeptide of the present invention preferably comprises or consists of the amino acid sequence of SEQ ID NO: 106 or an allelic variant thereof; or is a fragment thereof having xanthan lyase activity. In another aspect, the polypeptide comprises or consists of the mature polypeptide of SEQ ID NO: 106. In another aspect, the polypeptide comprises or consists of amino acids 1 to 901 of SEQ ID NO: 106.

In an embodiment, the present invention relates to isolated polypeptides having xanthan lyase activity and having a sequence identity to the mature polypeptide of SEQ ID NO: 110 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 110. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 110.

A polypeptide of the present invention preferably comprises or consists of the amino acid sequence of SEQ ID NO: 110 or an allelic variant thereof; or is a fragment thereof having xanthan lyase activity. In another aspect, the polypeptide comprises or consists of the mature polypeptide of SEQ ID NO: 110. In another aspect, the polypeptide comprises or consists of amino acids 1 to 899 of SEQ ID NO: 110.

In an embodiment, the present invention relates to isolated polypeptides having xanthan lyase activity and having a sequence identity to the mature polypeptide of SEQ ID NO: 114 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 114. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 114.

A polypeptide of the present invention preferably comprises or consists of the amino acid sequence of SEQ ID NO: 114 or an allelic variant thereof; or is a fragment thereof having xanthan lyase activity. In another aspect, the polypeptide comprises or consists of the mature polypeptide of SEQ ID NO: 114. In another aspect, the polypeptide comprises or consists of amino acids 1 to 897 of SEQ ID NO: 114.

In an embodiment, the present invention relates to isolated polypeptides having xanthan lyase activity and having a sequence identity to the mature polypeptide of SEQ ID NO: 118 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 118. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 118.

A polypeptide of the present invention preferably comprises or consists of the amino acid sequence of SEQ ID NO: 118 or an allelic variant thereof; or is a fragment thereof having xanthan lyase activity. In another aspect, the polypeptide comprises or consists of the mature polypeptide of SEQ ID NO: 118. In another aspect, the polypeptide comprises or consists of amino acids 1 to 933 of SEQ ID NO: 118.

In an embodiment, the present invention relates to isolated polypeptides having xanthan lyase activity and having a sequence identity to the mature polypeptide of SEQ ID NO: 122 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 122. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 122.

A polypeptide of the present invention preferably comprises or consists of the amino acid sequence of SEQ ID NO: 122 or an allelic variant thereof; or is a fragment thereof having xanthan lyase activity. In another aspect, the polypeptide comprises or consists of the mature polypeptide of SEQ ID NO: 122. In another aspect, the polypeptide comprises or consists of amino acids 1 to 1049 of SEQ ID NO: 122.

In an embodiment, the present invention relates to isolated polypeptides having xanthan lyase activity and having a sequence identity to the mature polypeptide of SEQ ID NO: 126 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 126. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 126.

A polypeptide of the present invention preferably comprises or consists of the amino acid sequence of SEQ ID NO: 126 or an allelic variant thereof; or is a fragment thereof having xanthan lyase activity. In another aspect, the polypeptide comprises or consists of the mature polypeptide of SEQ ID NO: 126. In another aspect, the polypeptide comprises or consists of amino acids 1 to 900 of SEQ ID NO: 126.

In another embodiment, the present invention relates to an isolated polypeptide having xanthan lyase activity encoded by a polynucleotide that hybridizes under medium stringency conditions, medium-high stringency conditions, high stringency conditions, or very high stringency conditions with the mature polypeptide coding sequence of SEQ ID NO: 3, SEQ ID NO: 45, SEQ ID NO: 59, SEQ ID NO: 63, SEQ ID NO: 105, SEQ ID NO: 109, SEQ ID NO: 113, SEQ ID NO: 117, SEQ ID NO: 121, SEQ ID NO: 125, or the full-length complement thereof (Sambrook et al., 1989, *Molecular Cloning, A Laboratory Manual*, 2d edition, Cold Spring Harbor, N.Y.).

The polynucleotide of SEQ ID NO: 3, SEQ ID NO: 45, SEQ ID NO: 59, SEQ ID NO: 63, SEQ ID NO: 105, SEQ ID NO: 109, SEQ ID NO: 113, SEQ ID NO: 117, SEQ ID NO: 121, SEQ ID NO: 125, or a subsequence thereof, as well as the polypeptide of SEQ ID NO: 4, SEQ ID NO: 46, SEQ ID NO: 60, SEQ ID NO: 64, SEQ ID NO: 106, SEQ ID NO: 110, SEQ ID NO: 114, SEQ ID NO: 118, SEQ ID NO: 122, SEQ ID NO: 126 or a fragment thereof, may be used to design nucleic acid probes to identify and clone DNA encoding polypeptides having xanthan lyase activity from strains of different genera or species according to methods well known in the art. In particular, such probes can be used for hybridization with the genomic DNA or cDNA of a cell of interest, following standard Southern blotting procedures, in order to identify and isolate the corresponding gene therein. Such probes can be considerably shorter than the entire sequence, but should be at least 15, e.g., at least 25, at least 35, or at least 70 nucleotides in length. Preferably, the nucleic acid probe is at least 100 nucleotides in length, e.g., at least 200 nucleotides, at least 300 nucleotides, at least 400 nucleotides, at least 500 nucleotides, at least 600 nucleotides, at least 700 nucleotides, at least 800 nucleotides, or at least 900 nucleotides in length. Both DNA and RNA probes can be used. The probes are typically labelled for detecting the corresponding gene (for example, with $^{32}$P, $^{3}$H, $^{35}$S, biotin, or avidin). Such probes are encompassed by the present invention.

A genomic DNA or cDNA library prepared from such other strains may be screened for DNA that hybridizes with the probes described above and encodes a polypeptide having xanthan lyase activity. Genomic or other DNA from such other strains may be separated by agarose or polyacrylamide gel electrophoresis, or other separation techniques. DNA from the libraries or the separated DNA may be transferred to and immobilized on nitrocellulose or other suitable carrier material. In order to identify a clone or DNA that hybridizes with SEQ ID NO: 3, SEQ ID NO: 45, SEQ ID NO: 59, SEQ ID NO: 63, SEQ ID NO: 105, SEQ ID NO: 109, SEQ ID NO: 113, SEQ ID NO: 117, SEQ ID NO: 121, SEQ ID NO: 125 or a subsequence thereof, the carrier material is used in a Southern blot.

For purposes of the present invention, hybridization indicates that the polynucleotide hybridizes to a labelled nucleic acid probe corresponding to (i) SEQ ID NO: 1, SEQ ID NO: 9, SEQ ID NO: 11, SEQ ID NO: 13, SEQ ID NO: 47, SEQ ID NO: 51, SEQ ID NO: 55, SEQ ID NO: 81, SEQ ID NO: 85, SEQ ID NO: 89, SEQ ID NO: 93, SEQ ID NO: 97, SEQ ID NO: 129, SEQ ID NO: 133 or SEQ ID NO: 137; (ii) the mature polypeptide coding sequence of SEQ ID NO: 1, SEQ ID NO: 9, SEQ ID NO: 11, SEQ ID NO: 13, SEQ ID NO: 47, SEQ ID NO: 51, SEQ ID NO: 55, SEQ ID NO: 81, SEQ ID NO: 85, SEQ ID NO: 89, SEQ ID NO: 93, SEQ ID NO: 97, SEQ ID NO: 129, SEQ ID NO: 133 or SEQ ID NO: 137; (iii) the full-length complement thereof; (iv) a subsequence thereof; (v) SEQ ID NO: 3, SEQ ID NO: 45, SEQ ID NO: 59, SEQ ID NO: 63, SEQ ID NO: 105, SEQ ID NO: 109, SEQ ID NO: 113, SEQ ID NO: 117, SEQ ID NO: 121, SEQ ID NO: 125; (vi) the mature polypeptide coding sequence of SEQ ID NO: 3, SEQ ID NO: 45, SEQ ID NO: 59, SEQ ID NO: 63, SEQ ID NO: 105, SEQ ID NO: 109, SEQ ID NO: 113, SEQ ID NO: 117, SEQ ID NO: 121, SEQ ID NO: 125; (vii) the full-length complement thereof; or (viii) a subsequence thereof; under medium stringency conditions to very high stringency conditions. Molecules to which the nucleic acid probe hybridizes under these conditions can be detected using, for example, X-ray film or any other detection means known in the art.

In one aspect, the nucleic acid probe is a polynucleotide that encodes the polypeptide of SEQ ID NO: 2, SEQ ID NO: 10, SEQ ID NO: 12, SEQ ID NO: 14, SEQ ID NO: 48, SEQ ID NO: 52, SEQ ID NO: 56, SEQ ID NO: 82, SEQ ID NO: 86, SEQ ID NO: 90, SEQ ID NO: 94, SEQ ID NO: 98, SEQ ID NO: 130, SEQ ID NO: 134 or SEQ ID NO: 138; the mature polypeptide thereof; or a fragment thereof. In another aspect, the nucleic acid probe is SEQ ID NO: 1, SEQ ID NO: 9, SEQ ID NO: 11, SEQ ID NO: 13, SEQ ID NO: 47, SEQ ID NO: 51, SEQ ID NO: 55, SEQ ID NO: 81, SEQ ID NO: 85, SEQ ID NO: 89, SEQ ID NO: 93, SEQ ID NO: 97, SEQ ID NO: 129, SEQ ID NO: 133 or SEQ ID NO: 137.

In one aspect, the nucleic acid probe is a polynucleotide that encodes the polypeptide of SEQ ID NO: 4, SEQ ID NO: 46, SEQ ID NO: 60, SEQ ID NO: 64, SEQ ID NO: 106, SEQ ID NO: 110, SEQ ID NO: 114, SEQ ID NO: 118, SEQ ID NO: 122 or SEQ ID NO: 126; the mature polypeptide thereof; or a fragment thereof. In another aspect, the nucleic acid probe is SEQ ID NO: 3, SEQ ID NO: 45, SEQ ID NO: 59, SEQ ID NO: 63, SEQ ID NO: 105, SEQ ID NO: 109, SEQ ID NO: 113, SEQ ID NO: 117, SEQ ID NO: 121 or SEQ ID NO: 125.

In another embodiment, the present invention relates to an isolated GH9 endoglucanase having activity on xanthan gum pretreated with xanthan lyase encoded by a polynucleotide having a sequence identity to the mature polypeptide coding sequence of SEQ ID NO: 1 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated GH9 endoglucanase having activity on xanthan gum pretreated with xanthan lyase encoded by a polynucleotide having a sequence identity to the mature polypeptide coding sequence of SEQ ID NO: 9 of at least 85%, e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated GH9 endoglucanase having activity on xanthan gum pretreated with xanthan lyase encoded by a polynucleotide having a sequence identity to the mature polypeptide coding sequence of SEQ ID NO: 11 of at least 90%, e.g., at least 91%, at least 92%, at least 93%, at least 94%, at least 95%, at least 96%, at least 97%, at least 98%, at least 99%, or 100%.

In another embodiment, the present invention relates to an isolated GH9 endoglucanases having activity on xanthan gum pretreated with xanthan lyase encoded by a polynucleotide having a sequence identity to the mature polypeptide coding sequence of SEQ ID NO: 13 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated GH9 endoglucanase having activity on xanthan gum pretreated with xanthan lyase encoded by a polynucleotide having a sequence identity to the mature polypeptide coding sequence of SEQ ID NO: 47 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated GH9 endoglucanase having activity on xanthan gum pretreated with xanthan lyase encoded by a polynucleotide having a sequence identity to the mature polypeptide coding sequence of SEQ ID NO: 51 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated GH9 endoglucanase having activity on xanthan gum pretreated with xanthan lyase encoded by a polynucleotide having a sequence identity to the mature polypeptide coding sequence of SEQ ID NO: 55 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated GH9 endoglucanase having activity on xanthan gum pretreated with xanthan lyase encoded by a polynucleotide having a sequence identity to the mature polypeptide coding sequence of SEQ ID NO: 81 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated GH9 endoglucanase having activity on xanthan gum pretreated with xanthan lyase encoded by a polynucleotide having a sequence identity to the mature polypeptide coding sequence of SEQ ID NO: 85 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated GH9 endoglucanase having activity on xanthan gum pretreated with xanthan lyase encoded by a polynucleotide having a sequence identity to the mature polypeptide coding sequence of SEQ ID NO: 89 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated GH9 endoglucanase having activity on xanthan gum pretreated with xanthan lyase encoded by a polynucleotide having a sequence identity to the mature polypeptide coding sequence of SEQ ID NO: 93 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated GH9 endoglucanase having activity on xanthan gum pretreated with xanthan lyase encoded by a polynucleotide having a sequence identity to the mature polypeptide coding sequence of SEQ ID NO: 97 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated GH9 endoglucanase having activity on xanthan gum pretreated with xanthan lyase encoded by a polynucleotide having a sequence identity to the mature polypeptide coding sequence of SEQ ID NO: 129 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated GH9 endoglucanase having activity on xanthan gum pretreated with xanthan lyase encoded by a polynucleotide having a sequence identity to the mature polypeptide coding sequence of SEQ ID NO: 133 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated GH9 endoglucanase having activity on xanthan gum pretreated with xanthan lyase encoded by a polynucleotide having a sequence identity to the mature polypeptide coding sequence of SEQ ID NO: 137 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated polypeptide having xanthan lyase activity encoded by a polynucleotide having a sequence identity to the mature polypeptide coding sequence of SEQ ID NO: 3 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated polypeptide having xanthan lyase activity encoded by a polynucleotide having a sequence identity to the mature polypeptide coding sequence of SEQ ID NO: 45 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated polypeptide having xanthan lyase activity encoded by a polynucleotide having a sequence identity to the mature polypeptide coding sequence of SEQ ID NO: 59 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated polypeptide having xanthan lyase activity encoded by a polynucleotide having a sequence identity to the mature polypeptide coding sequence of SEQ ID NO: 63 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated polypeptide having xanthan lyase activity encoded by a polynucleotide having a sequence identity to the mature polypeptide coding sequence of SEQ ID NO: 105 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated polypeptide having xanthan lyase activity encoded by a polynucleotide having a sequence identity to the mature polypeptide coding sequence of SEQ ID NO: 109 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated polypeptide having xanthan lyase activity encoded by a polynucleotide having a sequence identity to the mature polypeptide coding sequence of SEQ ID NO: 113 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated polypeptide having xanthan lyase activity encoded by a polynucleotide having a sequence identity to the mature polypeptide coding sequence of SEQ ID NO: 117 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated polypeptide having xanthan lyase activity encoded by a polynucleotide having a sequence identity to the mature polypeptide coding sequence of SEQ ID NO: 121 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to an isolated polypeptide having xanthan lyase activity encoded by a polynucleotide having a sequence identity to the mature polypeptide coding sequence of SEQ ID NO: 125 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%.

In another embodiment, the present invention relates to variants of the mature polypeptide of SEQ ID NO: 2 comprising a substitution, deletion, and/or insertion at one or more (e.g., several) positions. In an embodiment, the number of amino acid substitutions, deletions and/or insertions introduced into the mature polypeptide of SEQ ID NO: 2 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 4 comprising a substitution, deletion, and/or insertion at one or more (e.g., several) positions. In an embodiment, the number of amino acid substitutions, deletions and/or insertions introduced into the mature polypeptide of SEQ ID NO: 4 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to variants of the mature polypeptide of SEQ ID NO: 10 comprising a substitution, deletion, and/or insertion at one or more (e.g., several) positions. In an embodiment, the number of amino acid substitutions, deletions and/or insertions introduced into the mature polypeptide of SEQ ID NO: 10 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 12 comprising a substitution, deletion, and/or insertion at one or more (e.g., several) positions. In an embodiment, the number of amino acid substitutions, deletions and/or insertions introduced into the mature polypeptide of SEQ ID NO: 12 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 14 comprising a substitution, deletion, and/or insertion at one or more (e.g., several) positions. In an embodiment, the number of amino acid substitutions, deletions and/or insertions introduced into the mature polypeptide of SEQ ID NO: 14 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 46 comprising a substitution, deletion, and/or insertion at one or more (e.g., several) positions. In an embodiment, the number of amino acid substitutions, deletions and/or insertions introduced into the mature polypeptide of SEQ ID NO: 46 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to variants of the mature polypeptide of SEQ ID NO: 48 comprising a substitution, deletion, and/or insertion at one or more (e.g., several) positions. In an embodiment, the number of amino acid substitutions, deletions and/or insertions introduced into the mature polypeptide of SEQ ID NO: 48 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 52 comprising a substitution, deletion, and/or insertion at one or more (e.g., several) positions. In an embodiment, the number of amino acid substitutions, deletions and/or insertions introduced into the mature polypeptide of SEQ ID NO: 52 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 52 comprising a substitution, deletion, and/or insertion at one or more (e.g., several) positions. In an embodiment, the number of amino acid substitutions, deletions and/or insertions introduced into the mature polypeptide of SEQ ID NO: 52 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 56 comprising a substitution, deletion, and/or insertion at one or more (e.g., several) positions. In an embodiment, the number of amino acid substitutions, deletions and/or insertions introduced into the mature polypeptide of SEQ ID NO: 56 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 60 comprising a substitution, deletion, and/or insertion at one or more (e.g., several) positions. In an embodiment, the number of amino acid substitutions, deletions and/or insertions introduced into the mature polypeptide of SEQ ID NO: 60 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to variants of the mature polypeptide of SEQ ID NO: 64 comprising a substitution, deletion, and/or insertion at one or more (e.g., several) positions. In an embodiment, the number of amino acid substitutions, deletions and/or insertions introduced into the mature polypeptide of SEQ ID NO: 64 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to variants of the mature polypeptide of SEQ ID NO: 82 comprising a substitution, deletion, and/or insertion at one or more (e.g., several) positions. In an embodiment, the number of amino acid substitutions, deletions and/or insertions introduced into the mature polypeptide of SEQ ID NO: 82 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 86 comprising a substitution, deletion, and/or insertion at one or more (e.g., several) positions. In an embodiment, the number of amino acid substitutions, deletions and/or insertions introduced into the mature polypeptide of SEQ ID NO: 86 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 90 comprising a substitution, deletion, and/or insertion at one or more (e.g., several) positions. In an embodiment, the number of amino acid substitutions, deletions and/or insertions introduced into the mature polypeptide of SEQ ID NO: 90 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 94 comprising a substitution, deletion, and/or insertion at one or more (e.g., several) positions. In an embodiment, the number of amino acid substitutions, deletions and/or insertions introduced into the mature polypeptide of SEQ ID NO: 94 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 98 comprising a substitution, deletion, and/or insertion at one or more (e.g., several) positions. In an embodiment, the number of amino acid substitutions, deletions and/or insertions introduced into the mature polypeptide of SEQ ID NO: 98 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 102 comprising a substitution, deletion, and/or insertion at one or more (e.g., several) positions. In an embodiment, the number of amino acid substitutions, deletions and/or insertions introduced into the mature polypeptide of SEQ ID NO: 102 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 106 comprising a substitution, deletion, and/or insertion at one or more (e.g., several) positions. In an embodiment, the number of amino acid substitutions, deletions and/or insertions introduced into the mature polypeptide of SEQ ID NO: 106 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to variants of the mature polypeptide of SEQ ID NO: 110 comprising a substitution, deletion, and/or insertion at one or more (e.g., several) positions. In an embodiment, the number of amino acid substitutions, deletions and/or insertions introduced into the mature polypeptide of SEQ ID NO: 110 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to variants of the mature polypeptide of SEQ ID NO: 114 comprising a substitution, deletion, and/or insertion at one or more (e.g., several) positions. In an embodiment, the number of amino acid substitutions, deletions and/or insertions introduced into the mature polypeptide of SEQ ID NO: 114 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to variants of the mature polypeptide of SEQ ID NO: 118 comprising a substitution, deletion, and/or insertion at one or more (e.g., several) positions. In an embodiment, the number of amino acid substitutions, deletions and/or insertions introduced into the mature polypeptide of SEQ ID NO: 118 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to variants of the mature polypeptide of SEQ ID NO: 122 comprising a substitution, deletion, and/or insertion at one or more (e.g., several) positions. In an embodiment, the number of amino acid substitutions, deletions and/or insertions introduced into the mature polypeptide of SEQ ID NO: 122 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to variants of the mature polypeptide of SEQ ID NO: 126 comprising a substitution, deletion, and/or insertion at one or more (e.g., several) positions. In an embodiment, the number of amino acid substitutions, deletions and/or insertions introduced into the mature polypeptide of SEQ ID NO: 126 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to variants of the mature polypeptide of SEQ ID NO: 130 comprising a substitution, deletion, and/or insertion at one or more (e.g., several) positions. In an embodiment, the number of amino acid substitutions, deletions and/or insertions introduced into the mature polypeptide of SEQ ID NO: 130 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 134 comprising a substitution, deletion, and/or insertion at one or more (e.g., several) positions. In an embodiment, the number of amino acid substitutions, deletions and/or insertions introduced into the mature polypeptide of SEQ ID NO: 134 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to variants of the mature polypeptide of SEQ ID NO: 138 comprising a substitution, deletion, and/or insertion at one or more (e.g., several) positions. In an embodiment, the number of amino acid substitutions, deletions and/or insertions introduced into the mature polypeptide of SEQ ID NO: 138 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

Examples of conservative substitutions are within the groups of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions that do not generally alter specific activity are known in the art and are described, for example, by H. Neurath and R. L. Hill, 1979, In, *The Proteins*, Academic Press, New York. Common substitutions are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly.

Alternatively, the amino acid changes are of such a nature that the physico-chemical properties of the polypeptides are altered. For example, amino acid changes may improve the thermal stability of the polypeptide, alter the substrate specificity, change the pH optimum, and the like.

Essential amino acids in a polypeptide can be identified according to procedures known in the art, such as site-directed mutagenesis or alanine-scanning mutagenesis (Cunningham and Wells, 1989, *Science* 244: 1081-1085). In the latter technique, single alanine mutations are introduced at every residue in the molecule, and the resultant mutant molecules are tested for cellulase and/or xanthan lyase activity to identify amino acid residues that are critical to the activity of the molecule. See also, Hilton et al., 1996, *J. Biol. Chem.* 271: 4699-4708. The active site of the enzyme or other biological interaction can also be determined by physical analysis of structure, as determined by such techniques as nuclear magnetic resonance, crystallography, electron diffraction, or photoaffinity labelling, in conjunction with mutation of putative contact site amino acids. See, for example, de Vos et al., 1992, *Science* 255: 306-312; Smith et al., 1992, *J. Mol. Biol.* 224: 899-904; Wlodaver et al., 1992, *FEBS Lett.* 309: 59-64. The identity of essential amino acids can also be inferred from an alignment with a related polypeptide.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, 1988, *Science* 241: 53-57; Bowie and Sauer, 1989, *Proc. Natl. Acad. Sci. USA* 86: 2152-2156; WO 95/17413; or WO 95/22625. Other methods that can be used include error-prone PCR, phage display (e.g., Lowman et al., 1991, *Biochemistry* 30: 10832-10837; U.S. Pat. No. 5,223,409; WO 92/06204), and region-directed mutagenesis (Derbyshire et al., 1986, *Gene* 46: 145; Ner et al., 1988, *DNA* 7: 127).

Mutagenesis/shuffling methods can be combined with high-throughput, automated screening methods to detect activity of cloned, mutagenized polypeptides expressed by host cells (Ness et al., 1999, *Nature Biotechnology* 17: 893-896). Mutagenized DNA molecules that encode active polypeptides can be recovered from the host cells and rapidly sequenced using standard methods in the art. These methods allow the rapid determination of the importance of individual amino acid residues in a polypeptide.

The polypeptide may be a hybrid polypeptide in which a region of one polypeptide is fused at the N-terminus or the C-terminus of a region of another polypeptide.

The polypeptide may be a fusion polypeptide or cleavable fusion polypeptide in which another polypeptide is fused at the N-terminus or the C-terminus of the polypeptide of the present invention. A fusion polypeptide is produced by fusing a polynucleotide encoding another polypeptide to a polynucleotide of the present invention. Techniques for producing fusion polypeptides are known in the art, and include ligating the coding sequences encoding the polypeptides so that they are in frame and that expression of the fusion polypeptide is under control of the same promoter(s) and terminator. Fusion polypeptides may also be constructed using intein technology in which fusion polypeptides are created post-translationally (Cooper et al., 1993, *EMBO J.* 12: 2575-2583; Dawson et al., 1994, *Science* 266: 776-779).

A fusion polypeptide can further comprise a cleavage site between the two polypeptides. Upon secretion of the fusion protein, the site is cleaved releasing the two polypeptides. Examples of cleavage sites include, but are not limited to, the sites disclosed in Martin et al., 2003, *J. Ind. Microbiol. Biotechnol.* 3: 568-576; Svetina et al., 2000, *J. Biotechnol.* 76: 245-251; Rasmussen-Wilson et al., 1997, *Appl. Environ. Microbiol.* 63: 3488-3493; Ward et al., 1995, *Biotechnology* 13: 498-503; and Contreras et al., 1991, *Biotechnology* 9: 378-381; Eaton et al., 1986, *Biochemistry* 25: 505-512; Collins-Racie et al., 1995, *Biotechnology* 13: 982-987; Carter et al., 1989, *Proteins: Structure, Function, and Genetics* 6: 240-248; and Stevens, 2003, *Drug Discovery World* 4: 35-48.

The polypeptide may be expressed by a recombinant DNA sequence containing the coding for a His-tag or HQ-tag to give, after any post-translational modifications, the mature polypeptide containing all or part of the His- or HQ-tag. The HQ-tag, having the sequence -RHQHQHQ, may be fully or partly cleaved off the polypeptide during the post-translational modifications resulting in for example the additional amino acids -RHQHQ attached to the N-terminal of the mature polypeptide. The His-tag, having the sequence -RPHHHHHH, may be fully or partly cleaved off the polypeptide during the post-translational modifications resulting in additional amino acids such as -RPHHHHH, -RPHHHH, -RPHHH, -RPHH, -RPH, -RP or -R attached to the N-terminal of the mature polypeptide.

Compositions Comprising GH9 Endoglucanases Having Activity on Xanthan Gum Pretreated With Xanthan Lyase and Polypeptides Having Xanthan Lyase Activity In an embodiment, the present invention relates to a composition comprising isolated GH9 endoglucanases having activity on xanthan gum pretreated with xanthan lyase and having a sequence identity to the mature polypeptide of SEQ ID NO: 2 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 2. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 2.

A composition comprising a polypeptide of the present invention preferably comprises or consists of the amino acid sequence of SEQ ID NO: 2 or an allelic variant thereof; or is a fragment thereof having endoglucanase activity and activity on xanthan gum pretreated with xanthan lyase. In another aspect, the composition comprises a polypeptide that comprises or consists of the mature polypeptide of SEQ ID NO: 2. In another aspect, the composition comprises a polypeptide that comprises or consists of amino acids 1 to 1055 of SEQ ID NO: 2.

In another embodiment, the present invention relates to a composition comprising isolated GH9 endoglucanases having activity on xanthan gum pretreated with xanthan lyase and having a sequence identity to the mature polypeptide of SEQ ID NO: 10 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 10. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 10.

A composition comprising a polypeptide of the present invention preferably comprises or consists of the amino acid sequence of SEQ ID NO: 10 or an allelic variant thereof; or is a fragment thereof having endoglucanase activity and having activity on xanthan gum pretreated with xanthan lyase. In another aspect, the polypeptide comprises or consists of the mature polypeptide of SEQ ID NO: 10. In another aspect, the composition comprises a polypeptide that comprises or consists of amino acids 1 to 918 of SEQ ID NO: 10.

In a further embodiment, the present invention relates to a composition comprising isolated GH9 endoglucanases having activity on xanthan gum pretreated with xanthan lyase and having a sequence identity to the mature polypeptide of SEQ ID NO: 12 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 12. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 12.

A composition comprising a polypeptide of the present invention preferably comprises or consists of the amino acid sequence of SEQ ID NO: 12 or an allelic variant thereof; or is a fragment thereof having activity on xanthan gum pretreated with xanthan lyase. In another aspect, the composition comprises a polypeptide that comprises or consists of the mature polypeptide of SEQ ID NO: 12. In another aspect, the composition comprises a polypeptide that comprises or consists of amino acids 1 to 916 of SEQ ID NO: 12.

In a further embodiment, the present invention relates to a composition comprising isolated GH9 endoglucanases having activity on xanthan gum pretreated with xanthan lyase and having a sequence identity to the mature polypeptide of SEQ ID NO: 14 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 14. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 14.

A composition comprising a polypeptide of the present invention preferably comprises or consists of the amino acid sequence of SEQ ID NO: 14 or an allelic variant thereof; or is a fragment thereof having activity on xanthan gum pretreated with xanthan lyase. In another aspect, the composition comprises a polypeptide that comprises or consists of the mature polypeptide of SEQ ID NO: 14. In another aspect, the composition comprises a polypeptide that comprises or consists of amino acids 1 to 918 of SEQ ID NO: 14.

In a further embodiment, the present invention relates to a composition comprising isolated GH9 endoglucanases having activity on xanthan gum pretreated with xanthan lyase and having a sequence identity to the mature polypeptide of SEQ ID NO: 48 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 48. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 48.

A composition comprising a polypeptide of the present invention preferably comprises or consists of the amino acid sequence of SEQ ID NO: 48 or an allelic variant thereof; or is a fragment thereof having activity on xanthan gum pretreated with xanthan lyase. In another aspect, the composition comprises a polypeptide that comprises or consists of the mature polypeptide of SEQ ID NO: 48. In another aspect, the composition comprises a polypeptide that comprises or consists of amino acids 1 to 1007 of SEQ ID NO: 48.

In a further embodiment, the present invention relates to a composition comprising isolated GH9 endoglucanases having activity on xanthan gum pretreated with xanthan lyase and having a sequence identity to the mature polypeptide of SEQ ID NO: 52 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 52. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 52.

A composition comprising a polypeptide of the present invention preferably comprises or consists of the amino acid sequence of SEQ ID NO: 52 or an allelic variant thereof; or is a fragment thereof having activity on xanthan gum pretreated with xanthan lyase. In another aspect, the composition comprises a polypeptide that comprises or consists of the mature polypeptide of SEQ ID NO: 52. In another aspect, the composition comprises a polypeptide that comprises or consists of amino acids 1 to 915 of SEQ ID NO: 52.

In a further embodiment, the present invention relates to a composition comprising isolated GH9 endoglucanases having activity on xanthan gum pretreated with xanthan lyase and having a sequence identity to the mature polypeptide of SEQ ID NO: 56 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 56. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 56.

A composition comprising a polypeptide of the present invention preferably comprises or consists of the amino acid sequence of SEQ ID NO: 56 or an allelic variant thereof; or is a fragment thereof having activity on xanthan gum pretreated with xanthan lyase. In another aspect, the composition comprises a polypeptide that comprises or consists of the mature polypeptide of SEQ ID NO: 56. In another aspect, the composition comprises a polypeptide that comprises or consists of amino acids 1 to 1056 of SEQ ID NO: 56.

In a further embodiment, the present invention relates to a composition comprising isolated GH9 endoglucanases having activity on xanthan gum pretreated with xanthan lyase and having a sequence identity to the mature polypeptide of SEQ ID NO: 82 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 82. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 82.

A composition comprising a polypeptide of the present invention preferably comprises or consists of the amino acid sequence of SEQ ID NO: 82 or an allelic variant thereof; or is a fragment thereof having activity on xanthan gum pretreated with xanthan lyase. In another aspect, the composition comprises a polypeptide that comprises or consists of the mature polypeptide of SEQ ID NO: 82. In another aspect, the composition comprises a polypeptide that comprises or consists of amino acids 1 to 1371 of SEQ ID NO: 82.

In a further embodiment, the present invention relates to a composition comprising isolated GH9 endoglucanases having activity on xanthan gum pretreated with xanthan lyase and having a sequence identity to the mature polypeptide of SEQ ID NO: 86 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 86. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 86.

A composition comprising a polypeptide of the present invention preferably comprises or consists of the amino acid sequence of SEQ ID NO: 86 or an allelic variant thereof; or is a fragment thereof having activity on xanthan gum pretreated with xanthan lyase. In another aspect, the composition comprises a polypeptide that comprises or consists of the mature polypeptide of SEQ ID NO: 86. In another aspect, the composition comprises a polypeptide that comprises or consists of amino acids 1 to 1203 of SEQ ID NO: 86.

In a further embodiment, the present invention relates to a composition comprising isolated GH9 endoglucanases having activity on xanthan gum pretreated with xanthan lyase and having a sequence identity to the mature polypeptide of SEQ ID NO: 90 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 90. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 90.

A composition comprising a polypeptide of the present invention preferably comprises or consists of the amino acid sequence of SEQ ID NO: 90 or an allelic variant thereof; or is a fragment thereof having activity on xanthan gum pretreated with xanthan lyase. In another aspect, the composition comprises a polypeptide that comprises or consists of the mature polypeptide of SEQ ID NO: 90. In another aspect, the composition comprises a polypeptide that comprises or consists of amino acids 1 to 1379 of SEQ ID NO: 90.

In a further embodiment, the present invention relates to a composition comprising isolated GH9 endoglucanases having activity on xanthan gum pretreated with xanthan lyase and having a sequence identity to the mature polypeptide of SEQ ID NO: 94 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 94. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 94.

A composition comprising a polypeptide of the present invention preferably comprises or consists of the amino acid sequence of SEQ ID NO: 94 or an allelic variant thereof; or is a fragment thereof having activity on xanthan gum pretreated with xanthan lyase. In another aspect, the composition comprises a polypeptide that comprises or consists of the mature polypeptide of SEQ ID NO: 94. In another aspect, the composition comprises a polypeptide that comprises or consists of amino acids 1 to 1371 of SEQ ID NO: 94.

In a further embodiment, the present invention relates to a composition comprising isolated GH9 endoglucanases having activity on xanthan gum pretreated with xanthan lyase and having a sequence identity to the mature polypeptide of SEQ ID NO: 98 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 98. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 98.

A composition comprising a polypeptide of the present invention preferably comprises or consists of the amino acid sequence of SEQ ID NO: 98 or an allelic variant thereof; or is a fragment thereof having activity on xanthan gum pretreated with xanthan lyase. In another aspect, the composition comprises a polypeptide that comprises or consists of the mature polypeptide of SEQ ID NO: 98. In another aspect, the composition comprises a polypeptide that comprises or consists of amino acids 1 to 1372 of SEQ ID NO: 98.

In a further embodiment, the present invention relates to a composition comprising isolated GH9 endoglucanases having activity on xanthan gum pretreated with xanthan lyase and having a sequence identity to the mature polypeptide of SEQ ID NO: 102 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 102. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 102.

A composition comprising a polypeptide of the present invention preferably comprises or consists of the amino acid sequence of SEQ ID NO: 102 or an allelic variant thereof; or is a fragment thereof having activity on xanthan gum pretreated with xanthan lyase. In another aspect, the composition comprises a polypeptide that comprises or consists of the mature polypeptide of SEQ ID NO: 102. In another aspect, the composition comprises a polypeptide that comprises or consists of amino acids 1 to 922 of SEQ ID NO: 102.

In a further embodiment, the present invention relates to a composition comprising isolated GH9 endoglucanases having activity on xanthan gum pretreated with xanthan lyase and having a sequence identity to the mature polypeptide of SEQ ID NO: 130 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising isolated GH9 endoglucanases having activity on xanthan gum pretreated with xanthan lyase and having a sequence identity to the mature polypeptide of SEQ ID NO: 130 of at least 85%.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 130. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 130.

A composition comprising a polypeptide of the present invention preferably comprises or consists of the amino acid sequence of SEQ ID NO: 130 or an allelic variant thereof; or is a fragment thereof having activity on xanthan gum pretreated with xanthan lyase. In another aspect, the composition comprises a polypeptide that comprises or consists of the mature polypeptide of SEQ ID NO: 130. In another aspect, the composition comprises a polypeptide that comprises or consists of amino acids 1 to 916 of SEQ ID NO: 130.

In a further embodiment, the present invention relates to a composition comprising isolated GH9 endoglucanases having activity on xanthan gum pretreated with xanthan lyase and having a sequence identity to the mature polypeptide of SEQ ID NO: 134 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 134. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 134.

A composition comprising a polypeptide of the present invention preferably comprises or consists of the amino acid sequence of SEQ ID NO: 134 or an allelic variant thereof; or is a fragment thereof having activity on xanthan gum pretreated with xanthan lyase. In another aspect, the composition comprises a polypeptide that comprises or consists of the mature polypeptide of SEQ ID NO: 134. In another aspect, the composition comprises a polypeptide that comprises or consists of amino acids 1 to 1373 of SEQ ID NO: 134.

In a further embodiment, the present invention relates to a composition comprising isolated GH9 endoglucanases having activity on xanthan gum pretreated with xanthan lyase and having a sequence identity to the mature polypeptide of SEQ ID NO: 138 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 138. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 138.

A composition comprising a polypeptide of the present invention preferably comprises or consists of the amino acid sequence of SEQ ID NO: 138 or an allelic variant thereof; or is a fragment thereof having activity on xanthan gum pretreated with xanthan lyase. In another aspect, the composition comprises a polypeptide that comprises or consists of the mature polypeptide of SEQ ID NO: 138. In another aspect, the composition comprises a polypeptide that comprises or consists of amino acids 1 to 1204 of SEQ ID NO: 138.

In another embodiment, the present invention relates to a composition comprising isolated GH9 endoglucanases having activity on xanthan gum pretreated with xanthan lyase encoded by a polynucleotide that hybridizes under medium stringency conditions, medium-high stringency conditions, high stringency conditions, or very high stringency conditions with the mature polypeptide coding sequence of SEQ ID NO: 1, SEQ ID NO: 9, SEQ ID NO: 11, SEQ ID NO: 13, SEQ ID NO: 47, SEQ ID NO: 51, SEQ ID NO: 55, SEQ ID NO: 81, SEQ ID NO: 85, SEQ ID NO: 89, SEQ ID NO: 93, SEQ ID NO: 97, SEQ ID NO: 129, SEQ ID NO: 133, SEQ ID NO: 137, or the full-length complement thereof (Sambrook et al., 1989, *Molecular Cloning, A Laboratory Manual*, 2d edition, Cold Spring Harbor, N.Y.). The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In an embodiment, the present invention relates to a composition comprising isolated polypeptides having xanthan lyase activity and having a sequence identity to the mature polypeptide of SEQ ID NO: 4 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 4. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 4.

A composition comprising a polypeptide of the present invention preferably comprises or consists of the amino acid sequence of SEQ ID NO: 4 or an allelic variant thereof; or is a fragment thereof having xanthan lyase activity. In another aspect, the composition comprises a polypeptide that comprises or consists of the mature polypeptide of SEQ ID NO: 4. In another aspect, the composition comprises a polypeptide that comprises or consists of amino acids 1 to 760 of SEQ ID NO: 4.

In an embodiment, the present invention relates to a composition comprising isolated polypeptides having lyase activity and having a sequence identity to the mature polypeptide of SEQ ID NO: 46 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 46. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 46.

A composition comprising a polypeptide of the present invention preferably comprises or consists of the amino acid sequence of SEQ ID NO: 46 or an allelic variant thereof; or is a fragment thereof having xanthan lyase activity. In another aspect, the composition comprises a polypeptide that comprises or consists of the mature polypeptide of SEQ ID NO: 46. In another aspect, the composition comprises a polypeptide that comprises or consists of amino acids 1 to 1043 of SEQ ID NO: 46.

In an embodiment, the present invention relates to a composition comprising isolated polypeptides having lyase activity and having a sequence identity to the mature polypeptide of SEQ ID NO: 60 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 60. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 60.

A composition comprising a polypeptide of the present invention preferably comprises or consists of the amino acid sequence of SEQ ID NO: 60 or an allelic variant thereof; or is a fragment thereof having xanthan lyase activity. In another aspect, the composition comprises a polypeptide that comprises or consists of the mature polypeptide of SEQ ID NO: 60. In another aspect, the composition comprises a polypeptide that comprises or consists of amino acids 1 to 896 of SEQ ID NO: 60.

In an embodiment, the present invention relates to a composition comprising isolated polypeptides having lyase activity and having a sequence identity to the mature polypeptide of SEQ ID NO: 64 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 64. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 64.

A composition comprising a polypeptide of the present invention preferably comprises or consists of the amino acid sequence of SEQ ID NO: 64 or an allelic variant thereof; or is a fragment thereof having xanthan lyase activity. In another aspect, the composition comprises a polypeptide that comprises or consists of the mature polypeptide of SEQ ID NO: 64. In another aspect, the composition comprises a polypeptide that comprises or consists of amino acids 1 to 1038 of SEQ ID NO: 64.

In an embodiment, the present invention relates to a composition comprising isolated polypeptides having lyase activity and having a sequence identity to the mature polypeptide of SEQ ID NO: 106 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 106. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 106.

A composition comprising a polypeptide of the present invention preferably comprises or consists of the amino acid sequence of SEQ ID NO: 106 or an allelic variant thereof; or is a fragment thereof having xanthan lyase activity. In another aspect, the composition comprises a polypeptide that comprises or consists of the mature polypeptide of SEQ ID NO: 106. In another aspect, the composition comprises a polypeptide that comprises or consists of amino acids 1 to 901 of SEQ ID NO: 106.

In an embodiment, the present invention relates to a composition comprising isolated polypeptides having lyase activity and having a sequence identity to the mature polypeptide of SEQ ID NO: 110 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 110. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 110.

A composition comprising a polypeptide of the present invention preferably comprises or consists of the amino acid sequence of SEQ ID NO: 110 or an allelic variant thereof; or is a fragment thereof having xanthan lyase activity. In another aspect, the composition comprises a polypeptide that comprises or consists of the mature polypeptide of SEQ ID NO: 110. In another aspect, the composition comprises a polypeptide that comprises or consists of amino acids 1 to 899 of SEQ ID NO: 110.

In an embodiment, the present invention relates to a composition comprising isolated polypeptides having lyase activity and having a sequence identity to the mature polypeptide of SEQ ID NO: 114 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 114. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 114.

A composition comprising a polypeptide of the present invention preferably comprises or consists of the amino acid sequence of SEQ ID NO: 114 or an allelic variant thereof; or is a fragment thereof having xanthan lyase activity. In another aspect, the composition comprises a polypeptide that comprises or consists of the mature polypeptide of SEQ ID NO: 114. In another aspect, the composition comprises a polypeptide that comprises or consists of amino acids 1 to 897 of SEQ ID NO: 114.

In an embodiment, the present invention relates to a composition comprising isolated polypeptides having lyase activity and having a sequence identity to the mature polypeptide of SEQ ID NO: 118 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 118. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 118.

A composition comprising a polypeptide of the present invention preferably comprises or consists of the amino acid sequence of SEQ ID NO: 118 or an allelic variant thereof; or is a fragment thereof having xanthan lyase activity. In another aspect, the composition comprises a polypeptide that comprises or consists of the mature polypeptide of SEQ ID NO: 118. In another aspect, the composition comprises a polypeptide that comprises or consists of amino acids 1 to 933 of SEQ ID NO: 118.

In an embodiment, the present invention relates to a composition comprising isolated polypeptides having lyase activity and having a sequence identity to the mature polypeptide of SEQ ID NO: 122 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 122. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 122.

A composition comprising a polypeptide of the present invention preferably comprises or consists of the amino acid sequence of SEQ ID NO: 122 or an allelic variant thereof; or is a fragment thereof having xanthan lyase activity. In another aspect, the composition comprises a polypeptide that comprises or consists of the mature polypeptide of SEQ ID NO: 122. In another aspect, the composition comprises a polypeptide that comprises or consists of amino acids 1 to 1049 of SEQ ID NO: 122.

In an embodiment, the present invention relates to a composition comprising isolated polypeptides having lyase activity and having a sequence identity to the mature polypeptide of SEQ ID NO: 126 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In one aspect, the polypeptides differ by no more than 50 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49, from the mature polypeptide of SEQ ID NO: 126. In a preferred aspect, the polypeptides differ by no more than 10 amino acids, e.g., 1, 2, 3, 4, 5, 6, 7, 8, 9 or 10 amino acids, from the mature polypeptide of SEQ ID NO: 126.

A composition comprising a polypeptide of the present invention preferably comprises or consists of the amino acid sequence of SEQ ID NO: 126 or an allelic variant thereof; or is a fragment thereof having xanthan lyase activity. In another aspect, the composition comprises a polypeptide that comprises or consists of the mature polypeptide of SEQ ID NO: 126. In another aspect, the composition comprises a polypeptide that comprises or consists of amino acids 1 to 900 of SEQ ID NO: 126.

In another embodiment, the present invention relates to a composition comprising isolated polypeptides having xanthan lyase activity encoded by a polynucleotide that hybridizes under medium stringency conditions, medium-high stringency conditions, high stringency conditions, or very high stringency conditions with the mature polypeptide coding sequence of SEQ ID NO: 3, SEQ ID NO: 45, SEQ ID NO: 59, SEQ ID NO: 63, SEQ ID NO: 105, SEQ ID NO: 109, SEQ ID NO: 113, SEQ ID NO: 117, SEQ ID NO: 121, SEQ ID NO: 125, or the full-length complement thereof (Sambrook et al., 1989, *Molecular Cloning, A Laboratory Manual*, 2d edition, Cold Spring Harbor, N.Y.). The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 1 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 9 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 11 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to an isolated GH9 endoglucanases having activity on xanthan gum pretreated with xanthan lyase encoded by a polynucleotide having a sequence identity to the mature polypeptide coding sequence of SEQ ID NO: 13 of at least 80%, e.g., of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 47 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 51 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 55 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 81 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 85 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 89 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 93 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 97 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 101 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 129 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 133 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated GH9 endoglucanases having activity on xanthan gum pretreated with xanthan lyase encoded by a polynucleotide having a sequence identity to the mature polypeptide coding sequence of SEQ ID NO: 137 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated polypeptides having xanthan lyase activity encoded by a polynucleotide having a sequence identity to the mature polypeptide coding sequence of SEQ ID NO: 3 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated polypeptides having xanthan lyase activity encoded by a polynucleotide having a sequence identity to the mature polypeptide coding sequence of SEQ ID NO: 45 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated polypeptides having xanthan lyase activity encoded by a polynucleotide having a sequence identity to the mature polypeptide coding sequence of SEQ ID NO: 59 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated polypeptides having xanthan lyase activity encoded by a polynucleotide having a sequence identity to the mature polypeptide coding sequence of SEQ ID NO: 63 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated polypeptides having xanthan lyase activity encoded by a polynucleotide having a sequence identity to the mature polypeptide coding sequence of SEQ ID NO: 105 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated polypeptides having xanthan lyase activity encoded by a polynucleotide having a sequence identity to the mature polypeptide coding sequence of SEQ ID NO: 109 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated polypeptides having xanthan lyase activity encoded by a polynucleotide having a sequence identity to the mature polypeptide coding sequence of SEQ ID NO: 113 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated polypeptides having xanthan lyase activity encoded by a polynucleotide having a sequence identity to the mature polypeptide coding sequence of SEQ ID NO: 117 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated polypeptides having xanthan lyase activity encoded by a polynucleotide having a sequence identity to the mature polypeptide coding sequence of SEQ ID NO: 121 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to a composition comprising isolated polypeptides having xanthan lyase activity encoded by a polynucleotide having a sequence identity to the mature polypeptide coding sequence of SEQ ID NO: 125 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

In another embodiment, the present invention relates to compositions comprising variants of the mature polypeptide of SEQ ID NO: 2 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 2 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 4 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 4 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to compositions comprising variants of the mature polypeptide of SEQ ID NO: 10 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 10 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 12 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 12 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 14 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 14 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 46 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 46 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to compositions comprising variants of the mature polypeptide of SEQ ID NO: 48 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 48 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 52 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 52 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 56 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 56 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 60 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 60 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to compositions comprising variants of the mature polypeptide of SEQ ID NO: 64 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 64 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to compositions comprising variants of the mature polypeptide of SEQ ID NO: 82 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 82 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 86 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 86 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 90 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 90 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 94 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 94 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 98 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 98 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 102 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 102 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 106 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 106 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to compositions comprising variants of the mature polypeptide of SEQ ID NO: 110 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 110 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to compositions comprising variants of the mature polypeptide of SEQ ID NO: 114 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 114 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to compositions comprising variants of the mature polypeptide of SEQ ID NO: 118 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 118 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to compositions comprising variants of the mature polypeptide of SEQ ID NO: 122 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 122 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to compositions comprising variants of the mature polypeptide of SEQ ID NO: 126 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 126 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has xanthan lyase activity.

In another embodiment, the present invention relates to compositions comprising variants of the mature polypeptide of SEQ ID NO: 130 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 130 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 134 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 134 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

In another embodiment, the present invention relates to compositions comprising variants of the mature polypeptide of SEQ ID NO: 138 comprising a substitution, deletion, and/or insertion at one or more (e.g., several) positions. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. In an embodiment, the number of amino acid substitutions, deletions and/or insertions introduced into the mature polypeptide of SEQ ID NO: 138 is not more than 10, e.g., 1, 2, 3, 4, 5, 6, 7, 8 or 9. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a His-tag (poly-histidine tract), an antigenic epitope or a binding domain. The variant preferably has activity on xanthan gum pre-treated with xanthan lyase.

Examples of conservative substitutions are within the groups of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions that do not generally alter specific activity are known in the art and are described, for example, by H. Neurath and R. L. Hill, 1979, In, *The Proteins*, Academic Press, New York. Common substitutions are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly.

Alternatively, the amino acid changes are of such a nature that the physico-chemical properties of the polypeptides are altered. For example, amino acid changes may improve the thermal stability of the polypeptide, alter the substrate specificity, change the pH optimum, and the like.

Essential amino acids in a polypeptide can be identified according to procedures known in the art, such as site-directed mutagenesis or alanine-scanning mutagenesis (Cunningham and Wells, 1989, *Science* 244: 1081-1085). In the latter technique, single alanine mutations are introduced at every residue in the molecule, and the resultant mutant molecules are tested for cellulase and/or xanthan lyase activity to identify amino acid residues that are critical to the activity of the molecule. See also, Hilton et al., 1996, *J. Biol. Chem.* 271: 4699-4708. The active site of the enzyme or other biological interaction can also be determined by physical analysis of structure, as determined by such techniques as nuclear magnetic resonance, crystallography, electron diffraction, or photoaffinity labelling, in conjunction with mutation of putative contact site amino acids. See, for example, de Vos et al., 1992, *Science* 255: 306-312; Smith et al., 1992, *J. Mol. Biol.* 224: 899-904; Wlodaver et al., 1992, *FEBS Lett.* 309: 59-64. The identity of essential amino acids can also be inferred from an alignment with a related polypeptide.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, 1988, *Science* 241: 53-57; Bowie and Sauer, 1989, *Proc. Natl. Acad. Sci. USA* 86: 2152-2156; WO 95/17413; or WO 95/22625. Other methods that can be used include error-prone PCR, phage display (e.g., Lowman et al., 1991, *Biochemistry* 30: 10832-10837; U.S. Pat. No. 5,223,409; WO 92/06204), and region-directed mutagenesis (Derbyshire et al., 1986, *Gene* 46: 145; Ner et al., 1988, *DNA* 7: 127).

Mutagenesis/shuffling methods can be combined with high-throughput, automated screening methods to detect activity of cloned, mutagenized polypeptides expressed by host cells (Ness et al., 1999, *Nature Biotechnology* 17: 893-896). Mutagenized DNA molecules that encode active polypeptides can be recovered from the host cells and rapidly sequenced using standard methods in the art. These methods allow the rapid determination of the importance of individual amino acid residues in a polypeptide.

Embodiments

An embodiment of the invention is a composition comprising the GH9 endoglucanase of SEQ ID NO: 2 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids. An embodiment of the invention is a composition comprising the GH9 endoglucanase of SEQ ID NO: 2 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 2 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 2 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 2 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 2 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 2 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 2 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 2 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 2 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 10 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 10 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 10 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 10 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 10 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 10 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 10 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 10 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 10 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 10 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 12 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 12 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 12 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 12 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 12 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 12 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 12 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 12 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 12 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 12 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 14 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 14 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 14 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 14 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 14 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 14 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 14 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 14 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 14 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 14 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 48 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 48 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 48 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 48 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 48 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 48 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 48 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 48 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 48 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 48 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 52 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 52 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 52 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 52 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 52 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 52 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 52 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 52 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 52 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 52 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 56 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 56 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 56 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 56 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 56 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 56 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 56 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 56 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 56 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 56 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 82 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 82 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 82 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 82 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 82 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 82 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 82 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 82 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 82 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 82 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 86 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 86 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 86 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 86 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 86 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 86 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 86 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 86 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 86 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 86 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 90 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 90 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 90 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 90 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 90 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 90 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 90 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 90 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 90 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 90 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 94 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 94 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 94 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 94 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 94 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 94 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 94 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 94 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 94 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 94 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 98 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 98 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 98 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 98 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 98 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 98 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 98 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 98 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 98 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 98 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 102 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 102 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 102 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 102 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 102 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 102 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 102 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 102 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 102 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 102 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 130 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 130 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 130 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 130 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 130 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 130 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 130 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 130 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 130 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 130 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 134 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 134 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 134 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 134 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 134 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 134 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 134 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 134 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 134 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 134 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 138 with a polypeptide having xanthan lyase activity of SEQ ID NO: 4. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 138 with a polypeptide having xanthan lyase activity of SEQ ID NO: 46. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 138 with a polypeptide having xanthan lyase activity of SEQ ID NO: 60. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 138 with a polypeptide having xanthan lyase activity of SEQ ID NO: 64. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 138 with a polypeptide having xanthan lyase activity of SEQ ID NO: 106. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 138 with a polypeptide having xanthan lyase activity of SEQ ID NO: 110. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 138 with a polypeptide having xanthan lyase activity of SEQ ID NO: 114. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 138 with a polypeptide having xanthan lyase activity of SEQ ID NO: 118. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 138 with a polypeptide having xanthan lyase activity of SEQ ID NO: 122. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

An embodiment of the invention is a composition comprising the GH9 endoglucanase of SEQ ID NO: 138 with a polypeptide having xanthan lyase activity of SEQ ID NO: 126. The composition is preferably a detergent composition comprising one or more detergent components as defined herein, and may be used for washing or cleaning a textile and/or a hard surface such as dish wash. Alternatively, the composition may be used for degrading xanthan gum such as for controlling the viscosity of drilling fluids.

Sources of GH9 Endoglucanases Having Activity on Xanthan Gum Pretreated with Xanthan Lyase and Polypeptides Having Xanthan Lyase Activity A GH9 endoglucanase having activity on xanthan gum pretreated with a xanthan lyase of the present invention and polypeptides having xanthan lyase activity may be obtained from microorganisms of any genus. For purposes of the present invention, the term "obtained from" as used herein in connection with a given source shall mean that the polypeptide encoded by a polynucleotide is produced by the source or by a strain in which the polynucleotide from the source has been inserted. In one aspect, the polypeptide obtained from a given source is secreted extracellularly.

In one aspect, the polypeptide is from a bacterium of the class Bacilli, such as from the order Bacillales, or from the family Paenibacillaceae, or from the genus *Paeniobacillus* or from the species *Paeniobacillus* such as *Paeniobacillus* sp NN062047, *Paeniobacillus* sp NN062250, *Paeniobacillus* sp NN062253, *Paeniobacillus* sp NN018054, *Paeniobacillus* sp NN062046, *Paeniobacillus* sp NN062408, *Paeniobacillus* sp NN062332, *Paeniobacillus* sp NN062147 or *Paeniobacillus* sp NN062193.

In another aspect, the polypeptide from a bacterium of the class Actinobacteria, such as from the order Actinomycetales, or from the family Microbacteriaceae, or from the genus *Microbacterium* or from the species *Microbacterium* such as *Microbacterium testaceum*, *Microbacterium* sp NN062045, *Microbacterium* sp NN062148, *Microbacterium* sp NN062175 or *Microbacterium* sp NN062149.

It will be understood that for the aforementioned species, the invention encompasses both the perfect and imperfect states, and other taxonomic equivalents, e.g., anamorphs, regardless of the species name by which they are known. Those skilled in the art will readily recognize the identity of appropriate equivalents.

Strains of these species are readily accessible to the public in a number of culture collections, such as the American Type Culture Collection (ATCC), Deutsche Sammlung von Mikroorganismen and Zellkulturen GmbH (DSMZ), Centraalbureau Voor Schimmelcultures (CBS), and Agricultural Research Service Patent Culture Collection, Northern Regional Research Center (NRRL).

The polypeptide may be identified and obtained from other sources including microorganisms isolated from nature (e.g., soil, composts, water, etc.) or DNA samples obtained directly from natural materials (e.g., soil, composts, water, etc.) using the above-mentioned probes. Techniques for isolating microorganisms and DNA directly from natural habitats are well known in the art. A polynucleotide encoding the polypeptide may then be obtained by similarly screening a genomic DNA or cDNA library of another microorganism or mixed DNA sample. Once a polynucleotide encoding a polypeptide has been detected with the probe(s), the polynucleotide can be isolated or cloned by utilizing techniques that are known to those of ordinary skill in the art (see, e.g., Sambrook et al., 1989, supra).

Polynucleotides

The present invention also relates to isolated polynucleotides encoding a polypeptide of the present invention, as described herein.

The techniques used to isolate or clone a polynucleotide are known in the art and include isolation from genomic DNA or cDNA, or a combination thereof. The cloning of the polynucleotides from genomic DNA can be effected, e.g., by using the well known polymerase chain reaction (PCR) or antibody screening of expression libraries to detect cloned DNA fragments with shared structural features. See, e.g., Innis et al., 1990, *PCR: A Guide to Methods and Application*, Academic Press, New York. Other nucleic acid amplification procedures such as ligase chain reaction (LCR), ligation activated transcription (LAT) and polynucleotide-based amplification (NASBA) may be used. The polynucleotides may be cloned in a strain of *Bacillus subtilis* or *E. Coli*, or a related organism and thus, for example, may be an allelic or species variant of the polypeptide encoding region of the polynucleotide.

Modification of a polynucleotide encoding a polypeptide of the present invention may be necessary for synthesizing polypeptides substantially similar to the polypeptide. The term "substantially similar" to the polypeptide refers to non-naturally occurring forms of the polypeptide. These polypeptides may differ in some engineered way from the polypeptide isolated from its native source, e.g., variants that differ in specific activity, thermostability, pH optimum, or the like. The variants may be constructed on the basis of the polynucleotide presented as the mature polypeptide coding sequence of SEQ ID NO: 1, SEQ ID NO: 3, SEQ ID NO: 9, SEQ ID NO: 11, SEQ ID: NO:13, SEQ ID NO: 15, SEQ ID NO: 45, SEQ ID NO: 47, SEQ ID NO: 51, SEQ ID NO: 55, SEQ ID NO: 59, SEQ ID NO: 63, SEQ ID NO: 81, SEQ ID NO: 85, SEQ ID NO: 89, SEQ ID NO: 93, SEQ ID NO: 97, SEQ ID NO: 105, SEQ ID NO: 109, SEQ ID NO: 113, SEQ ID NO: 117, SEQ ID NO: 121, SEQ ID NO: 125, SEQ ID NO: 129, SEQ ID NO: 133 or SEQ ID NO: 137 e.g., a subsequence thereof, and/or by introduction of nucleotide substitutions that do not result in a change in the amino acid sequence of the polypeptide, but which correspond to the codon usage of the host organism intended for production of the enzyme, or by introduction of nucleotide substitutions that may give rise to a different amino acid sequence. For a general description of nucleotide substitution, see, Ford et al., (1991), '*Protein Expression and Purification*', 2: 95-107.

Nucleic Acid Constructs

The present invention also relates to nucleic acid constructs comprising a polynucleotide of the present invention operably linked to one or more control sequences that direct the expression of the coding sequence in a suitable host cell under conditions compatible with the control sequences.

A polynucleotide may be manipulated in a variety of ways to provide for expression of the polypeptide. Manipulation of the polynucleotide prior to its insertion into a vector may be desirable or necessary depending on the expression vector. The techniques for modifying polynucleotides utilizing recombinant DNA methods are well known in the art.

The control sequence may be a promoter, a polynucleotide that is recognized by a host cell for expression of a polynucleotide encoding a polypeptide of the present invention. The promoter contains transcriptional control sequences that mediate the expression of the polypeptide. The promoter may be any polynucleotide that shows transcriptional activity in the host cell including mutant, truncated, and hybrid promoters, and may be obtained from genes encoding extracellular or intracellular polypeptides either homologous or heterologous to the host cell.

Examples of suitable promoters for directing transcription of the nucleic acid constructs of the present invention in a bacterial host cell are the promoters obtained from the *Bacillus amyloliquefaciens* alpha-amylase gene (amyQ), *Bacillus licheniformis* alpha-amylase gene (amyL), *Bacillus licheniformis* penicillinase gene (penP), *Bacillus stearothermophilus* maltogenic amylase gene (amyM), *Bacillus subtilis* levansucrase gene (sacB), *Bacillus subtilis* xylA and xylB genes, *Bacillus thuringiensis* cryIIIA gene (Agaisse and Lereclus, 1994, *Molecular Microbiology* 13: 97-107), *E. coli* lac operon, *E. coli* trc promoter (Egon et al., 1988, *Gene* 69: 301-315), *Streptomyces coelicolor* agarase gene (dagA), and prokaryotic beta-lactamase gene (Villa-Kamaroff et al., 1978, *Proc. Natl. Acad. Sci. USA* 75: 3727-3731), as well as the tac promoter (DeBoer et al., 1983, *Proc. Natl. Acad. Sci. USA* 80: 21-25). Further promoters are described in "Useful proteins from recombinant bacteria" in Gilbert et al., 1980, *Scientific American* 242: 74-94; and in Sambrook et al., 1989, supra. Examples of tandem promoters are disclosed in WO 99/43835.

Examples of suitable promoters for directing transcription of the nucleic acid constructs of the present invention in a filamentous fungal host cell are promoters obtained from the genes for *Aspergillus nidulans* acetamidase, *Aspergillus niger* neutral alpha-amylase, *Aspergillus niger* acid stable alpha-amylase, *Aspergillus niger* or *Aspergillus awamori* glucoamylase (glaA), *Aspergillus oryzae* TAKA amylase, *Aspergillus oryzae* alkaline protease, *Aspergillus oryzae* triose phosphate isomerase, *Fusarium oxysporum* trypsin-like protease (WO 96/00787), *Fusarium venenatum* amyloglucosidase (WO 00/56900), *Fusarium venenatum* Daria (WO 00/56900), *Fusarium venenatum* Quinn (WO 00/56900), *Rhizomucor miehei* lipase, *Rhizomucor miehei* aspartic proteinase, *Trichoderma reesei* beta-glucosidase, *Trichoderma reesei* cellobiohydrolase I, *Trichoderma reesei* cellobiohydrolase II, *Trichoderma reesei* endoglucanase I, *Trichoderma reesei* endoglucanase II, *Trichoderma reesei* endoglucanase III, *Trichoderma reesei* endoglucanase IV, *Trichoderma reesei* endoglucanase V, *Trichoderma reesei* xylanase I, *Trichoderma reesei* xylanase II, *Trichoderma reesei* beta-xylosidase, as well as the NA2-tpi promoter (a modified promoter from an *Aspergillus* neutral alpha-amylase gene in which the untranslated leader has been replaced by an untranslated leader from an *Aspergillus* triose phosphate isomerase gene; non-limiting examples include modified promoters from an *Aspergillus niger* neutral alpha-amylase gene in which the untranslated leader has been replaced by an untranslated leader from an *Aspergillus nidulans* or *Aspergillus oryzae* triose phosphate isomerase gene); and mutant, truncated, and hybrid promoters thereof.

In a yeast host, useful promoters are obtained from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH1, ADH2/GAP), *Saccharomyces cerevisiae* triose phosphate isomerase (TPI), *Saccharomyces cerevisiae* metallothionein (CUP1), and *Saccharomyces cerevisiae* 3-phosphoglycerate kinase. Other useful promoters for yeast host cells are described by Romanos et al., 1992, *Yeast* 8: 423-488.

The control sequence may also be a transcription terminator, which is recognized by a host cell to terminate transcription. The terminator is operably linked to the 3'-terminus of the polynucleotide encoding the polypeptide. Any terminator that is functional in the host cell may be used in the present invention.

Preferred terminators for bacterial host cells are obtained from the genes for *Bacillus clausii* alkaline protease (aprH), *Bacillus licheniformis* alpha-amylase (amyL), and *Escherichia coli* ribosomal RNA (rrnB).

Preferred terminators for filamentous fungal host cells are obtained from the genes for *Aspergillus nidulans* anthranilate synthase, *Aspergillus niger* glucoamylase, *Aspergillus niger* alpha-glucosidase, *Aspergillus oryzae* TAKA amylase, and *Fusarium oxysporum* trypsin-like protease.

Preferred terminators for yeast host cells are obtained from the genes for *Saccharomyces cerevisiae* enolase, *Sac-* charomyces cerevisiae cytochrome C (CYC1), and Saccharomyces cerevisiae glyceraldehyde-3-phosphate dehydrogenase. Other useful terminators for yeast host cells are described by Romanos et al., 1992, supra.

The control sequence may also be an mRNA stabilizer region downstream of a promoter and upstream of the coding sequence of a gene which increases expression of the gene.

Examples of suitable mRNA stabilizer regions are obtained from a Bacillus thuringiensis cryIIIA gene (WO 94/25612) and a Bacillus subtilis SP82 gene (Hue et al., 1995, Journal of Bacteriology 177: 3465-3471).

The control sequence may also be a leader, a nontranslated region of an mRNA that is important for translation by the host cell. The leader is operably linked to the 5'-terminus of the polynucleotide encoding the polypeptide. Any leader that is functional in the host cell may be used.

Preferred leaders for filamentous fungal host cells are obtained from the genes for Aspergillus oryzae TAKA amylase and Aspergillus nidulans triose phosphate isomerase.

Suitable leaders for yeast host cells are obtained from the genes for Saccharomyces cerevisiae enolase (ENO-1), Saccharomyces cerevisiae 3-phosphoglycerate kinase, Saccharomyces cerevisiae alpha-factor, and Saccharomyces cerevisiae alcohol dehydrogenase/glyceraldehyde-3-phosphate dehydrogenase (ADH2/GAP).

The control sequence may also be a polyadenylation sequence, a sequence operably linked to the 3'-terminus of the polynucleotide and, when transcribed, is recognized by the host cell as a signal to add polyadenosine residues to transcribed mRNA. Any polyadenylation sequence that is functional in the host cell may be used.

Preferred polyadenylation sequences for filamentous fungal host cells are obtained from the genes for Aspergillus nidulans anthranilate synthase, Aspergillus niger glucoamylase, Aspergillus niger alpha-glucosidase Aspergillus oryzae TAKA amylase, and Fusarium oxysporum trypsin-like protease.

Useful polyadenylation sequences for yeast host cells are described by Guo and Sherman, 1995, Mol. Cellular Biol. 15: 5983-5990.

The control sequence may also be a signal peptide coding region that encodes a signal peptide linked to the N-terminus of a polypeptide and directs the polypeptide into the cell's secretory pathway. The 5'-end of the coding sequence of the polynucleotide may inherently contain a signal peptide coding sequence naturally linked in translation reading frame with the segment of the coding sequence that encodes the polypeptide. Alternatively, the 5'-end of the coding sequence may contain a signal peptide coding sequence that is foreign to the coding sequence. A foreign signal peptide coding sequence may be required where the coding sequence does not naturally contain a signal peptide coding sequence. Alternatively, a foreign signal peptide coding sequence may simply replace the natural signal peptide coding sequence in order to enhance secretion of the polypeptide. However, any signal peptide coding sequence that directs the expressed polypeptide into the secretory pathway of a host cell may be used.

Effective signal peptide coding sequences for bacterial host cells are the signal peptide coding sequences obtained from the genes for Bacillus NCIB 11837 maltogenic amylase, Bacillus licheniformis subtilisin, Bacillus licheniformis beta-lactamase, Bacillus stearothermophilus alpha-amylase, Bacillus stearothermophilus neutral proteases (nprT, nprS, nprM), and Bacillus subtilis prsA. Further signal peptides are described by Simonen and Palva, 1993, Microbiological Reviews 57: 109-137.

Effective signal peptide coding sequences for filamentous fungal host cells are the signal peptide coding sequences obtained from the genes for Aspergillus niger neutral amylase, Aspergillus niger glucoamylase, Aspergillus oryzae TAKA amylase, Humicola insolens cellulase, Humicola insolens endoglucanase V, Humicola lanuginosa lipase, and Rhizomucor miehei aspartic proteinase.

Useful signal peptides for yeast host cells are obtained from the genes for Saccharomyces cerevisiae alpha-factor and Saccharomyces cerevisiae invertase. Other useful signal peptide coding sequences are described by Romanos et al., 1992, supra.

The control sequence may also be a propeptide coding sequence that encodes a propeptide positioned at the N-terminus of a polypeptide. The resultant polypeptide is known as a proenzyme or propolypeptide (or a zymogen in some cases). A propolypeptide is generally inactive and can be converted to an active polypeptide by catalytic or autocatalytic cleavage of the propeptide from the propolypeptide. The propeptide coding sequence may be obtained from the genes for Bacillus subtilis alkaline protease (aprE), Bacillus subtilis neutral protease (nprT), Myceliophthora thermophila laccase (WO 95/33836), Rhizomucor miehei aspartic proteinase, and Saccharomyces cerevisiae alpha-factor.

Where both signal peptide and propeptide sequences are present, the propeptide sequence is positioned next to the N-terminus of a polypeptide and the signal peptide sequence is positioned next to the N-terminus of the propeptide sequence.

It may also be desirable to add regulatory sequences that regulate expression of the polypeptide relative to the growth of the host cell. Examples of regulatory systems are those that cause expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used. In filamentous fungi, the Aspergillus niger glucoamylase promoter, Aspergillus oryzae TAKA alpha-amylase promoter, and Aspergillus oryzae glucoamylase promoter may be used. Other examples of regulatory sequences are those that allow for gene amplification. In eukaryotic systems, these regulatory sequences include the dihydrofolate reductase gene that is amplified in the presence of methotrexate, and the metallothionein genes that are amplified with heavy metals. In these cases, the polynucleotide encoding the polypeptide would be operably linked with the regulatory sequence.

Expression Vectors

The present invention also relates to recombinant expression vectors comprising a polynucleotide of the present invention, a promoter, and transcriptional and translational stop signals. The various nucleotide and control sequences may be joined together to produce a recombinant expression vector that may include one or more convenient restriction sites to allow for insertion or substitution of the polynucleotide encoding the polypeptide at such sites. Alternatively, the polynucleotide may be expressed by inserting the polynucleotide or a nucleic acid construct comprising the polynucleotide into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector may be a linear or closed circular plasmid.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the host cell, or a transposon, may be used.

The vector preferably contains one or more selectable markers that permit easy selection of transformed, transfected, transduced, or the like cells. A selectable marker is a gene the product of which provides for biocide or viral resistance, resistance to heavy metals, prototrophy to auxotrophs, and the like.

Examples of bacterial selectable markers are *Bacillus licheniformis* or *Bacillus subtilis* dal genes, or markers that confer antibiotic resistance such as ampicillin, chloramphenicol, kanamycin, neomycin, spectinomycin, or tetracycline resistance. Suitable markers for yeast host cells include, but are not limited to, ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Preferred for use in an *Aspergillus* cell are *Aspergillus nidulans* or *Aspergillus oryzae* amdS and pyrG genes and a *Streptomyces hygroscopicus* bar gene.

The vector preferably contains an element(s) that permits integration of the vector into the host cell's genome or autonomous replication of the vector in the cell independent of the genome.

For integration into the host cell genome, the vector may rely on the polynucleotide's sequence encoding the polypeptide or any other element of the vector for integration into the genome by homologous or non-homologous recombination. Alternatively, the vector may contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination.

For autonomous replication, the vector may further comprise an origin of replication enabling the vector to replicate autonomously in the host cell in question. The origin of replication may be any plasmid replicator mediating autonomous replication that functions in a cell. The term "origin of replication" or "plasmid replicator" means a polynucleotide that enables a plasmid or vector to replicate in vivo.

Examples of bacterial origins of replication are the origins of replication of plasmids pBR322, pUC19, pACYC177, and pACYC184 permitting replication in *E. coli*, and pUB110, pE194, pTA1060, and pAMβ1 permitting replication in *Bacillus*.

Examples of origins of replication for use in a yeast host cell are the 2 micron origin of replication, ARS1, ARS4, the combination of ARS1 and CEN3, and the combination of ARS4 and CEN6.

Examples of origins of replication useful in a filamentous fungal cell are AMA1 and ANS1 (Gems et al., 1991, *Gene* 98: 61-67; Cullen et al., 1987, *Nucleic Acids Res.* 15: 9163-9175; WO 00/24883). Isolation of the AMA1 gene and construction of plasmids or vectors comprising the gene can be accomplished according to the methods disclosed in WO 00/24883.

More than one copy of a polynucleotide of the present invention may be inserted into a host cell to increase production of a polypeptide. An increase in the copy number of the polynucleotide can be obtained by integrating at least one additional copy of the sequence into the host cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors of the present invention are well known to one skilled in the art (see, e.g., Sambrook et al., 1989, supra).

Host Cells

The present invention also relates to recombinant host cells, comprising a polynucleotide of the present invention operably linked to one or more control sequences that direct the production of a polypeptide of the present invention. A construct or vector comprising a polynucleotide is introduced into a host cell so that the construct or vector is maintained as a chromosomal integrant or as a self-replicating extra-chromosomal vector as described earlier. The term "host cell" encompasses any progeny of a parent cell that is not identical to the parent cell due to mutations that occur during replication. The choice of a host cell will to a large extent depend upon the gene encoding the polypeptide and its source.

The host cell may be any cell useful in the recombinant production of a polypeptide of the present invention, e.g., a prokaryote or a eukaryote.

The prokaryotic host cell may be any Gram-positive or Gram-negative bacterium. Gram-positive bacteria include, but are not limited to, *Bacillus, Clostridium, Enterococcus, Geobacillus, Lactobacillus, Lactococcus, Oceanobacillus, Staphylococcus, Streptococcus*, and *Streptomyces*. Gram-negative bacteria include, but are not limited to, *Campylobacter, E. coli, Flavobacterium, Fusobacterium, Helicobacter, Ilyobacter, Neisseria, Pseudomonas, Salmonella*, and *Ureaplasma*.

The bacterial host cell may be any *Bacillus* cell including, but not limited to, *Bacillus alkalophilus, Bacillus amyloliquefaciens, Bacillus brevis, Bacillus circulans, Bacillus*

*clausii, Bacillus coagulans, Bacillus firmus, Bacillus lautus, Bacillus lentus, Bacillus licheniformis, Bacillus megaterium, Bacillus pumilus, Bacillus stearothermophilus, Bacillus subtilis,* and *Bacillus thuringiensis* cells.

The bacterial host cell may also be any *Streptococcus* cell including, but not limited to, *Streptococcus equisimilis, Streptococcus pyogenes, Streptococcus uberis,* and *Streptococcus equi* subsp. *Zooepidemicus* cells.

The bacterial host cell may also be any *Streptomyces* cell including, but not limited to, *Streptomyces achromogenes, Streptomyces avermitilis, Streptomyces coelicolor, Streptomyces griseus,* and *Streptomyces lividans* cells.

The introduction of DNA into a *Bacillus* cell may be effected by protoplast transformation (see, e.g., Chang and Cohen, 1979, *Mol. Gen. Genet.* 168: 111-115), competent cell transformation (see, e.g., Young and Spizizen, 1961, *J. Bacteriol.* 81: 823-829, or Dubnau and Davidoff-Abelson, 1971, *J. Mol. Biol.* 56: 209-221), electroporation (see, e.g., Shigekawa and Dower, 1988, *Biotechniques* 6: 742-751), or conjugation (see, e.g., Koehler and Thorne, 1987, *J. Bacteriol.* 169: 5271-5278). The introduction of DNA into an *E. coli* cell may be effected by protoplast transformation (see, e.g., Hanahan, 1983, *J. Mol. Biol.* 166: 557-580) or electroporation (see, e.g., Dower et al., 1988, *Nucleic Acids Res.* 16: 6127-6145). The introduction of DNA into a *Streptomyces* cell may be effected by protoplast transformation, electroporation (see, e.g., Gong et al., 2004, *Folia Microbiol. (Praha)* 49: 399-405), conjugation (see, e.g., Mazodier et al., 1989, *J. Bacteriol.* 171: 3583-3585), or transduction (see, e.g., Burke et al., 2001, *Proc. Natl. Acad. Sci. USA* 98: 6289-6294). The introduction of DNA into a *Pseudomonas* cell may be effected by electroporation (see, e.g., Choi et al., 2006, *J. Microbiol. Methods* 64: 391-397) or conjugation (see, e.g., Pinedo and Smets, 2005, *Appl. Environ. Microbiol.* 71: 51-57). The introduction of DNA into a *Streptococcus* cell may be effected by natural competence (see, e.g., Perry and Kuramitsu, 1981, *Infect. Immun.* 32: 1295-1297), protoplast transformation (see, e.g., Catt and Jollick, 1991, *Microbios* 68: 189-207), electroporation (see, e.g., Buckley et al., 1999, *Appl. Environ. Microbiol.* 65: 3800-3804), or conjugation (see, e.g., Clewell, 1981, *Microbiol. Rev.* 45: 409-436). However, any method known in the art for introducing DNA into a host cell can be used.

The host cell may also be a eukaryote, such as a mammalian, insect, plant, or fungal cell.

The host cell may be a fungal cell. "Fungi" as used herein includes the phyla Ascomycota, Basidiomycota, Chytridiomycota, and Zygomycota as well as the Oomycota and all mitosporic fungi (as defined by Hawksworth et al., In, *Ainsworth and Bisby's Dictionary of The Fungi,* 8th edition, 1995, CAB International, University Press, Cambridge, UK).

The fungal host cell may be a yeast cell. "Yeast" as used herein includes ascosporogenous yeast (Endomycetales), basidiosporogenous yeast, and yeast belonging to the Fungi Imperfecti (Blastomycetes). Since the classification of yeast may change in the future, for the purposes of this invention, yeast shall be defined as described in *Biology and Activities of Yeast* (Skinner, Passmore, and Davenport, editors, Soc. App. Bacteriol. Symposium Series No. 9, 1980).

The yeast host cell may be a *Candida, Hansenula, Kluyveromyces, Pichia, Saccharomyces, Schizosaccharomyces,* or *Yarrowia* cell, such as a *Kluyveromyces lactis, Saccharomyces carlsbergensis, Saccharomyces cerevisiae, Saccharomyces diastaticus, Saccharomyces douglasii, Saccharomyces kluyveri, Saccharomyces norbensis, Saccharomyces oviformis,* or *Yarrowia lipolytica* cell.

The fungal host cell may be a filamentous fungal cell. "Filamentous fungi" include all filamentous forms of the subdivision Eumycota and Oomycota (as defined by Hawksworth et al., 1995, supra). The filamentous fungi are generally characterized by a mycelial wall composed of chitin, cellulose, glucan, chitosan, mannan, and other complex polysaccharides. Vegetative growth is by hyphal elongation and carbon catabolism is obligately aerobic. In contrast, vegetative growth by yeasts such as *Saccharomyces cerevisiae* is by budding of a unicellular thallus and carbon catabolism may be fermentative.

The filamentous fungal host cell may be an *Acremonium, Aspergillus, Aureobasidium, Bjerkandera, Ceriporiopsis, Chrysosporium, Coprinus, Coriolus, Cryptococcus, Filibasidium, Fusarium, Humicola, Magnaporthe, Mucor, Myceliophthora, Neocallimastix, Neurospora, Paecilomyces, Penicillium, Phanerochaete, Phlebia, Piromyces, Pleurotus, Schizophyllum, Talaromyces, Thermoascus, Thielavia, Tolypocladium, Trametes,* or *Trichoderma* cell.

For example, the filamentous fungal host cell may be an *Aspergillus awamori, Aspergillus foetidus, Aspergillus fumigatus, Aspergillus japonicus, Aspergillus nidulans, Aspergillus niger, Aspergillus oryzae, Bjerkandera adusta, Ceriporiopsis aneirina, Ceriporiopsis caregiea, Ceriporiopsis gilvescens, Ceriporiopsis pannocinta, Ceriporiopsis rivulosa, Ceriporiopsis subrufa, Ceriporiopsis subvermispora, Chrysosporium inops, Chrysosporium keratinophilum, Chrysosporium lucknowense, Chrysosporium merdarium, Chrysosporium pannicola, Chrysosporium queenslandicum, Chrysosporium tropicum, Chrysosporium zonatum, Coprinus cinereus, Coriolus hirsutus, Fusarium bactridioides, Fusarium cerealis, Fusarium crookwellense, Fusarium culmorum, Fusarium graminearum, Fusarium graminum, Fusarium heterosporum, Fusarium negundi, Fusarium oxysporum, Fusarium reticulatum, Fusarium roseum, Fusarium sambucinum, Fusarium sarcochroum, Fusarium sporotrichioides, Fusarium sulphureum, Fusarium torulosum, Fusarium trichothecioides, Fusarium venenatum, Humicola insolens, Humicola lanuginosa, Mucor miehei, Myceliophthora thermophila, Neurospora crassa, Penicillium purpurogenum, Phanerochaete chrysosporium, Phlebia radiata, Pleurotus eryngii, Thielavia terrestris, Trametes villosa, Trametes versicolor, Trichoderma harzianum, Trichoderma koningii, Trichoderma longibrachiatum, Trichoderma reesei,* or *Trichoderma viride* cell.

Fungal cells may be transformed by a process involving protoplast formation, transformation of the protoplasts, and regeneration of the cell wall in a manner known per se. Suitable procedures for transformation of *Aspergillus* and *Trichoderma* host cells are described in EP 238023, Yelton et al., 1984, *Proc. Natl. Acad. Sci. USA* 81: 1470-1474, and Christensen et al., 1988, *Bio/Technology* 6: 1419-1422. Suitable methods for transforming *Fusarium* species are described by Malardier et al., 1989, *Gene* 78: 147-156, and WO 96/00787. Yeast may be transformed using the procedures described by Becker and Guarente, In Abelson, J. N. and Simon, M. I., editors, *Guide to Yeast Genetics and Molecular Biology, Methods in Enzymology*, Volume 194, pp 182-187, Academic Press, Inc., New York; Ito et al., 1983, *J. Bacteriol.* 153: 163; and Hinnen et al., 1978, *Proc. Natl. Acad. Sci. USA* 75: 1920.

Methods of Production

The present invention also relates to methods of producing a polypeptide of the present invention, comprising (a) cultivating a cell, which in its wild-type form produces the polypeptide, under conditions conducive for production of the polypeptide; and (b) recovering the polypeptide. In a preferred aspect, the cell is a *Paenibacillus* cell, or a *Microbacterium* cell.

The present invention also relates to methods of producing a polypeptide of the present invention, comprising (a) cultivating a recombinant host cell of the present invention under conditions conducive for production of the polypeptide; and (b) recovering the polypeptide.

The host cells are cultivated in a nutrient medium suitable for production of the polypeptide using methods known in the art. For example, the cell may be cultivated by shake flask cultivation, or small-scale or large-scale fermentation (including continuous, batch, fed-batch, or solid state fermentations) in laboratory or industrial fermentors performed in a suitable medium and under conditions allowing the polypeptide to be expressed and/or isolated. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection). If the polypeptide is secreted into the nutrient medium, the polypeptide can be recovered directly from the medium. If the polypeptide is not secreted, it can be recovered from cell lysates.

The polypeptide may be detected using methods known in the art that are specific for the polypeptides such as methods for determining cellulose or xanthan lyase activity. These detection methods include, but are not limited to, use of specific antibodies, formation of an enzyme product, or disappearance of an enzyme substrate. For example, an enzyme assay may be used to determine the activity of the polypeptide.

The polypeptide may be recovered using methods known in the art. For example, the polypeptide may be recovered from the nutrient medium by conventional procedures including, but not limited to, collection, centrifugation, filtration, extraction, spray-drying, evaporation, or precipitation.

The polypeptide may be purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), SDS-PAGE, or extraction (see, e.g., *Protein Purification*, Janson and Ryden, editors, VCH Publishers, New York, 1989) to obtain substantially pure polypeptides.

In an alternative aspect, the polypeptide is not recovered, but rather a host cell of the present invention expressing the polypeptide is used as a source of the polypeptide.

Fermentation Broth Formulations or Cell Compositions

The present invention also relates to a fermentation broth formulation or a cell composition comprising a polypeptide of the present invention. The fermentation broth product further comprises additional ingredients used in the fermentation process, such as, for example, cells (including, the host cells containing the gene encoding the polypeptide of the present invention which are used to produce the polypeptide of interest), cell debris, biomass, fermentation media and/or fermentation products. In some embodiments, the composition is a cell-killed whole broth containing organic acid(s), killed cells and/or cell debris, and culture medium.

The term "fermentation broth" as used herein refers to a preparation produced by cellular fermentation that undergoes no or minimal recovery and/or purification. For example, fermentation broths are produced when microbial cultures are grown to saturation, incubated under carbon-limiting conditions to allow protein synthesis (e.g., expression of enzymes by host cells) and secretion into cell culture medium. The fermentation broth can contain unfractionated or fractionated contents of the fermentation materials derived at the end of the fermentation. Typically, the fermentation broth is unfractionated and comprises the spent culture medium and cell debris present after the microbial cells (e.g., filamentous fungal cells) are removed, e.g., by centrifugation. In some embodiments, the fermentation broth contains spent cell culture medium, extracellular enzymes, and viable and/or nonviable microbial cells.

In an embodiment, the fermentation broth formulation and cell compositions comprise a first organic acid component comprising at least one 1-5 carbon organic acid and/or a salt thereof and a second organic acid component comprising at least one 6 or more carbon organic acid and/or a salt thereof. In a specific embodiment, the first organic acid component is acetic acid, formic acid, propionic acid, a salt thereof, or a mixture of two or more of the foregoing and the second organic acid component is benzoic acid, cyclohexanecarboxylic acid, 4-methylvaleric acid, phenylacetic acid, a salt thereof, or a mixture of two or more of the foregoing.

In one aspect, the composition contains an organic acid(s), and optionally further contains killed cells and/or cell debris. In one embodiment, the killed cells and/or cell debris are removed from a cell-killed whole broth to provide a composition that is free of these components.

The fermentation broth formulations or cell compositions may further comprise a preservative and/or anti-microbial (e.g., bacteriostatic) agent, including, but not limited to, sorbitol, sodium chloride, potassium sorbate, and others known in the art.

The cell-killed whole broth or composition may contain the unfractionated contents of the fermentation materials derived at the end of the fermentation. Typically, the cell-killed whole broth or composition contains the spent culture medium and cell debris present after the microbial cells (e.g., filamentous fungal cells) are grown to saturation, incubated under carbon-limiting conditions to allow protein synthesis. In some embodiments, the cell-killed whole broth or composition contains the spent cell culture medium, extracellular enzymes, and killed filamentous fungal cells. In some embodiments, the microbial cells present in the cell-killed whole broth or composition can be permeabilized and/or lysed using methods known in the art.

A whole broth or cell composition as described herein is typically a liquid, but may contain insoluble components, such as killed cells, cell debris, culture media components, and/or insoluble enzyme(s). In some embodiments, insoluble components may be removed to provide a clarified liquid composition.

The whole broth formulations and cell compositions of the present invention may be produced by a method described in WO 90/15861 or WO 2010/096673.

Detergent Compositions

In one embodiment, the invention is directed to detergent compositions comprising an enzyme of the present invention in combination with one or more additional cleaning composition components. The choice of additional components is within the skill of the artisan and includes conventional ingredients, including the exemplary non-limiting components set forth below.

The choice of components may include, for textile care, the consideration of the type of textile to be cleaned, the type and/or degree of soiling, the temperature at which cleaning is to take place, and the formulation of the detergent product.

Although components mentioned below are categorized by general header according to a particular functionality, this is not to be construed as a limitation since the component may have one or more additional functionalities which the skilled artisan will appreciate.

The detergent composition may be suitable for the laundering of textiles such as e.g. fabrics, cloths or linen, or for cleaning hard surfaces such as e.g. floors, tables, or dish wash.

Enzyme of the Present Invention

In one embodiment of the present invention, the a polypeptide of the present invention may be added to a detergent composition in an amount corresponding to 0.0001-200 mg of enzyme protein, such as 0.0005-100 mg of enzyme protein, preferably 0.001-30 mg of enzyme protein, more preferably 0.005-8 mg of enzyme protein, even more preferably 0.01-2 mg of enzyme protein per liter of wash liquor.

A composition for use in automatic dishwash (ADW), for example, may include 0.0001%-50%, such as 0.001%-20%, such as 0.01%-10%, such as 0.05-5% of enzyme protein by weight of the composition.

A composition for use in laundry granulation, for example, may include 0.0001%-50%, such as 0.001%-20%, such as 0.01%-10%, such as 0.05%-5% of enzyme protein by weight of the composition.

A composition for use in laundry liquid, for example, may include 0.0001%-10%, such as 0.001-7%, such as 0.1%-5% of enzyme protein by weight of the composition.

The enzyme(s) of the detergent composition of the invention may be stabilized using conventional stabilizing agents, e.g., a polyol such as propylene glycol or glycerol, a sugar or sugar alcohol, lactic acid, boric acid, or a boric acid derivative, e.g., an aromatic borate ester, or a phenyl boronic acid derivative such as 4-formylphenyl boronic acid, and the composition may be formulated as described in, for example, WO92/19709 and WO92/19708.

In certain markets different wash conditions and, as such, different types of detergents are used. This is disclosed in e.g. EP 1 025 240. For example, In Asia (Japan) a low detergent concentration system is used, while the United States uses a medium detergent concentration system, and Europe uses a high detergent concentration system.

A low detergent concentration system includes detergents where less than about 800 ppm of detergent components are present in the wash water. Japanese detergents are typically considered low detergent concentration system as they have approximately 667 ppm of detergent components present in the wash water.

A medium detergent concentration includes detergents where between about 800 ppm and about 2000 ppm of detergent components are present in the wash water. North American detergents are generally considered to be medium detergent concentration systems as they have approximately 975 ppm of detergent components present in the wash water.

A high detergent concentration system includes detergents where greater than about 2000 ppm of detergent components are present in the wash water. European detergents are generally considered to be high detergent concentration systems as they have approximately 4500-5000 ppm of detergent components in the wash water.

Latin American detergents are generally high suds phosphate builder detergents and the range of detergents used in Latin America can fall in both the medium and high detergent concentrations as they range from 1500 ppm to 6000 ppm of detergent components in the wash water. Such detergent compositions are all embodiments of the invention.

A polypeptide of the present invention may also be incorporated in the detergent formulations disclosed in WO97/07202, which is hereby incorporated by reference.

Surfactants

The detergent composition may comprise one or more surfactants, which may be anionic and/or cationic and/or non-ionic and/or semi-polar and/or zwitterionic, or a mixture thereof. In a particular embodiment, the detergent composition includes a mixture of one or more nonionic surfactants and one or more anionic surfactants. The surfactant(s) is typically present at a level of from about 0.1% to 60% by weight, such as about 1% to about 40%, or about 3% to about 20%, or about 3% to about 10%. The surfactant(s) is chosen based on the desired cleaning application, and includes any conventional surfactant(s) known in the art. Any surfactant known in the art for use in detergents may be utilized.

When included therein the detergent will usually contain from about 1% to about 40% by weight, such as from about 5% to about 30%, including from about 5% to about 15%, or from about 20% to about 25% of an anionic surfactant. Non-limiting examples of anionic surfactants include sulfates and sulfonates, in particular, linear alkylbenzenesulfonates (LAS), isomers of LAS, branched alkylbenzenesulfonates (BABS), phenylalkanesulfonates, alpha-olefinsulfonates (AOS), olefin sulfonates, alkene sulfonates, alkane-2,3-diylbis(sulfates), hydroxyalkanesulfonates and disulfonates, alkyl sulfates (AS) such as sodium dodecyl sulfate (SDS), fatty alcohol sulfates (FAS), primary alcohol sulfates (PAS), alcohol ethersulfates (AES or AEOS or FES, also known as alcohol ethoxysulfates or fatty alcohol ether sulfates), secondary alkanesulfonates (SAS), paraffin sulfonates (PS), ester sulfonates, sulfonated fatty acid glycerol esters, alpha-sulfo fatty acid methyl esters (alpha-SFMe or SES) including methyl ester sulfonate (MES), alkyl- or alkenylsuccinic acid, dodecenyl/tetradecenyl succinic acid (DTSA), fatty acid derivatives of amino acids, diesters and monoesters of sulfo-succinic acid or soap, and combinations thereof.

When included therein the detergent will usually contain from about 0% to about 10% by weight of a cationic surfactant. Non-limiting examples of cationic surfactants include alklydimethylethanolamine quat (ADMEAQ), cetyltrimethylammonium bromide (CTAB), dimethyldistearylammonium chloride (DSDMAC), and alkylbenzyldimethylammonium, alkyl quaternary ammonium compounds, alkoxylated quaternary ammonium (AQA) compounds, and combinations thereof.

When included therein the detergent will usually contain from about 0.2% to about 40% by weight of a non-ionic surfactant, for example from about 0.5% to about 30%, in particular from about 1% to about 20%, from about 3% to about 10%, such as from about 3% to about 5%, or from about 8% to about 12%. Non-limiting examples of non-ionic surfactants include alcohol ethoxylates (AE or AEO), alcohol propoxylates, propoxylated fatty alcohols (PFA), alkoxylated fatty acid alkyl esters, such as ethoxylated and/or propoxylated fatty acid alkyl esters, alkylphenol ethoxylates (APE), nonylphenol ethoxylates (NPE), alkylpolyglycosides (APG), alkoxylated amines, fatty acid monoethanolamides (FAM), fatty acid diethanolamides (FADA), ethoxylated fatty acid monoethanolamides (EFAM), propoxylated fatty acid monoethanolamides (PFAM), polyhydroxy alkyl fatty acid amides, or N-acyl N-alkyl derivatives of glucosamine (glucamides, GA, or fatty acid glucamide, FAGA), as well as products available under the trade names SPAN and TWEEN, and combinations thereof.

When included therein the detergent will usually contain from about 0% to about 10% by weight of a semipolar surfactant. Non-limiting examples of semipolar surfactants include amine oxides (AO) such as alkyldimethylamineoxide, N-(coco alkyl)-N,N-dimethylamine oxide and N-(tallow-alkyl)-N,N-bis(2-hydroxyethyl)amine oxide, fatty acid alkanolamides and ethoxylated fatty acid alkanolamides, and combinations thereof.

When included therein the detergent will usually contain from about 0% to about 10% by weight of a zwitterionic surfactant. Non-limiting examples of zwitterionic surfactants include betaine, alkyldimethylbetaine, sulfobetaine, and combinations thereof.

Hydrotropes

A hydrotrope is a compound that solubilises hydrophobic compounds in aqueous solutions (or oppositely, polar substances in a non-polar environment). Typically, hydrotropes have both hydrophilic and a hydrophobic character (so-called amphiphilic properties as known from surfactants); however the molecular structure of hydrotropes generally do not favor spontaneous self-aggregation, see e.g. review by Hodgdon and Kaler (2007), Current Opinion in Colloid & Interface Science 12: 121-128. Hydrotropes do not display a critical concentration above which self-aggregation occurs as found for surfactants and lipids forming miceller, lamellar or other well defined meso-phases. Instead, many hydrotropes show a continuous-type aggregation process where the sizes of aggregates grow as concentration increases. However, many hydrotropes alter the phase behavior, stability, and colloidal properties of systems containing substances of polar and non-polar character, including mixtures of water, oil, surfactants, and polymers. Hydrotropes are classically used across industries from pharma, personal care, food, to technical applications. Use of hydrotropes in detergent compositions allow for example more concentrated formulations of surfactants (as in the process of compacting liquid detergents by removing water) without inducing undesired phenomena such as phase separation or high viscosity.

The detergent may contain 0-5% by weight, such as about 0.5 to about 5%, or about 3% to about 5%, of a hydrotrope. Any hydrotrope known in the art for use in detergents may be utilized. Non-limiting examples of hydrotropes include sodium benzene sulfonate, sodium p-toluene sulfonate (STS), sodium xylene sulfonate (SXS), sodium cumene sulfonate (SCS), sodium cymene sulfonate, amine oxides, alcohols and polyglycolethers, sodium hydroxynaphthoate, sodium hydroxynaphthalene sulfonate, sodium ethylhexyl sulfate, and combinations thereof.

Builders and Co-Builders

The detergent composition may contain about 0-65% by weight, such as about 5% to about 45% of a detergent builder or co-builder, or a mixture thereof. In a dish wash detergent, the level of builder is typically 40-65%, particularly 50-65%. The builder and/or co-builder may particularly be a chelating agent that forms water-soluble complexes with Ca and Mg. Any builder and/or co-builder known in the art for use in laundry detergents may be utilized. Non-limiting examples of builders include zeolites, diphosphates (pyrophosphates), triphosphates such as sodium triphosphate (STP or STPP), carbonates such as sodium carbonate, soluble silicates such as sodium metasilicate, layered silicates (e.g., SKS-6 from Hoechst), ethanolamines such as 2-aminoethan-1-ol (MEA), diethanolamine (DEA, also known as iminodiethanol), triethanolamine (TEA, also known as 2,2',2"-nitrilotriethanol), and carboxymethyl inulin (CMI), and combinations thereof.

The detergent composition may also contain 0-20% by weight, such as about 5% to about 10%, of a detergent co-builder, or a mixture thereof. The detergent composition may include include a co-builder alone, or in combination with a builder, for example a zeolite builder. Non-limiting examples of co-builders include homopolymers of polyacrylates or copolymers thereof, such as poly(acrylic acid) (PAA) or copoly(acrylic acid/maleic acid) (PAA/PMA). Further non-limiting examples include citrate, chelators such as aminocarboxylates, aminopolycarboxylates and phosphonates, and alkyl- or alkenylsuccinic acid. Additional specific examples include 2,2',2"-nitrilotriacetic acid (NTA), ethylenediaminetetraacetic acid (EDTA), diethylenetriaminepentaacetic acid (DTPA), iminodisuccinic acid (IDS), ethylenediamine-N,N'-disuccinic acid (EDDS), methylglycinediacetic acid (MGDA), glutamic acid-N,N-diacetic acid (GLDA), 1-hydroxyethane-1,1-diphosphonic acid (HEDP), ethylenediaminetetra-(methylenephosphonic acid) (EDTMPA), diethylenetriaminepentakis(methylenephosphonic acid) (DTPMPA or DTMPA), N-(2-hydroxyethyl)iminodiacetic acid (EDG), aspartic acid-N-monoacetic acid (ASMA), aspartic acid-N,N-diacetic acid (ASDA), aspartic acid-N-monopropionic acid (ASMP), iminodisuccinic acid (IDA), N-(2-sulfomethyl)-aspartic acid (SMAS), N-(2-sulfoethyl)-aspartic acid (SEAS), N-(2-sulfomethyl)-glutamic acid (SMGL), N-(2-sulfoethyl)-glutamic acid (SEGL), N-methyliminodiacetic acid (MIDA), α-alanine-N,N-diacetic acid (α-ALDA), serine-N,N-diacetic acid (SEDA), isoserine-N,N-diacetic acid (ISDA), phenylalanine-N,N-diacetic acid (PHDA), anthranilic acid-N,N-diacetic acid (ANDA), sulfanilic acid-N,N-diacetic acid (SLDA), taurine-N,N-diacetic acid (TUDA) and sulfomethyl-N,N-diacetic acid (SMDA), N-(2-hydroxyethyl)ethylidenediamine-N,N',N'-triacetate (HEDTA), diethanolglycine (DEG), diethylenetriamine penta(methylenephosphonic acid) (DTPMP), aminotris(methylenephosphonic acid) (ATMP), and combinations and salts thereof. Further exemplary builders and/or co-builders are described in, e.g., WO 09/102854, U.S. Pat. No. 5,977,053

Bleaching Systems

The detergent may contain 0-50% by weight, such as about 0.1% to about 25%, of a bleaching system. Any bleaching system known in the art for use in laundry detergents may be utilized. Suitable bleaching system components include bleaching catalysts, photobleaches, bleach activators, sources of hydrogen peroxide such as sodium percarbonate and sodium perborates, preformed peracids and mixtures thereof. Suitable preformed peracids include, but are not limited to, peroxycarboxylic acids and salts, percarbonic acids and salts, perimidic acids and salts, peroxymonosulfuric acids and salts, for example, Oxone (R), and mixtures thereof. Non-limiting examples of bleaching systems include peroxide-based bleaching systems, which may comprise, for example, an inorganic salt, including alkali metal salts such as sodium salts of perborate (usually mono- or tetra-hydrate), percarbonate, persulfate, perphosphate, persilicate salts, in combination with a peracid-forming bleach activator. The term bleach activator is meant herein as a compound which reacts with peroxygen bleach like hydrogen peroxide to form a peracid. The peracid thus formed constitutes the activated bleach. Suitable bleach activators to be used herein include those belonging to the class of esters amides, imides or anhydrides. Suitable examples are tetracetylethylene diamine (TAED), sodium 4-[(3,5,5-trimethylhexanoyl)oxy]benzene sulfonate (ISONOBS), diperoxy dodecanoic acid, 4-(dodecanoyloxy) benzenesulfonate (LOBS), 4-(decanoyloxy)benzenesulfonate, 4-(decanoyloxy)benzoate (DOBS), 4-(nonanoyloxy)-benzenesulfonate (NOBS), and/or those disclosed in WO98/17767. A particular family of bleach activators of interest was disclosed in EP624154 and particularly preferred in that family is acetyl triethyl citrate (ATC). ATC or a short chain triglyceride like triacetin has the advantage that it is environmental friendly as it eventually degrades into citric acid and alcohol. Furthermore acetyl triethyl citrate and triacetin has a good hydrolytical stability in the product upon storage and it is an efficient bleach activator. Finally ATC provides a good building capacity to the laundry additive. Alternatively, the bleaching system may comprise peroxyacids of, for example, the amide, imide, or sulfone type. The bleaching system may also comprise peracids such as 6-(phthalimido)peroxyhexanoic acid (PAP). The bleaching system may also include a bleach catalyst. In some embodiments the bleach component may be an organic catalyst selected from the group consisting of organic catalysts having the following formulae:

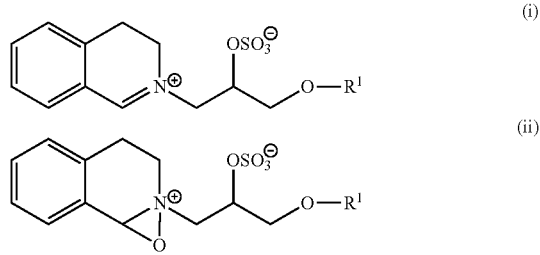

(iii) and mixtures thereof; wherein each $R^1$ is independently a branched alkyl group containing from 9 to 24 carbons or linear alkyl group containing from 11 to 24 carbons, preferably each $R^1$ is independently a branched alkyl group containing from 9 to 18 carbons or linear alkyl group containing from 11 to 18 carbons, more preferably each $R^1$ is independently selected from the group consisting of 2-propylheptyl, 2-butyloctyl, 2-pentylnonyl, 2-hexyldecyl, n-dodecyl, n-tetradecyl, n-hexadecyl, n-octadecyl, isononyl, iso-decyl, iso-tridecyl and iso-pentadecyl. Other exemplary bleaching systems are described, e.g. in WO2007/087258, WO2007/087244, WO2007/087259 and WO2007/087242. Suitable photobleaches may for example be sulfonated zinc phthalocyanine Polymers The detergent may contain 0-10% by weight, such as 0.5-5%, 2-5%, 0.5-2% or 0.2-1% of a polymer. Any polymer known in the art for use in detergents may be utilized. The polymer may function as a co-builder as mentioned above, or may provide antiredeposition, fiber protection, soil release, dye transfer inhibition, grease cleaning and/or antifoaming properties. Some polymers may have more than one of the above-mentioned properties and/or more than one of the below-mentioned motifs. Exemplary polymers include (carboxymethyl)cellulose (CMC), poly(vinyl alcohol) (PVA), poly(vinylpyrrolidone) (PVP), poly(ethyleneglycol) or poly(ethylene oxide) (PEG), ethoxylated poly (ethyleneimine), carboxymethyl inulin (CMI), and polycarboxylates such as PAA, PAA/PMA, poly-aspartic acid, and lauryl methacrylate/acrylic acid copolymers, hydrophobically modified CMC (HM-CMC) and silicones, copolymers of terephthalic acid and oligomeric glycols, copolymers of poly(ethylene terephthalate) and poly (oxyethene terephthalate) (PET-POET), PVP, poly(vinylimidazole) (PVI), poly(vinylpyridine-N-oxide) (PVPO or PVPNO) and polyvinylpyrrolidone-vinylimidazole (PVPVI). Further exemplary polymers include sulfonated polycarboxylates, polyethylene oxide and polypropylene oxide (PEO-PPO) and diquaternium ethoxy sulfate. Other exemplary polymers are disclosed in, e.g., WO 2006/130575. Salts of the above-mentioned polymers are also contemplated.

Fabric Hueing Agents

The detergent compositions of the present invention may also include fabric hueing agents such as dyes or pigments, which when formulated in detergent compositions can deposit onto a fabric when said fabric is contacted with a wash liquor comprising said detergent compositions and thus altering the tint of said fabric through absorption/reflection of visible light. Fluorescent whitening agents emit at least some visible light. In contrast, fabric hueing agents alter the tint of a surface as they absorb at least a portion of the visible light spectrum. Suitable fabric hueing agents include dyes and dye-clay conjugates, and may also include pigments. Suitable dyes include small molecule dyes and polymeric dyes. Suitable small molecule dyes include small molecule dyes selected from the group consisting of dyes falling into the Colour Index (C.I.) classifications of Direct Blue, Direct Red, Direct Violet, Acid Blue, Acid Red, Acid Violet, Basic Blue, Basic Violet and Basic Red, or mixtures thereof, for example as described in WO2005/03274, WO2005/03275, WO2005/03276 and EP1876226 (hereby incorporated by reference). The detergent composition preferably comprises from about 0.00003 wt % to about 0.2 wt %, from about 0.00008 wt % to about 0.05 wt %, or even from about 0.0001 wt % to about 0.04 wt % fabric hueing agent. The composition may comprise from 0.0001 wt % to 0.2 wt % fabric hueing agent, this may be especially preferred when the composition is in the form of a unit dose pouch. Suitable hueing agents are also disclosed in, e.g. WO 2007/087257 and WO2007/087243.

Additional Enzymes

The detergent additive as well as the detergent composition may comprise one or more [additional] enzymes such as a protease, lipase, cutinase, an amylase, carbohydrase, cellulase, pectinase, mannanase, arabinase, galactanase, xylanase, oxidase, e.g., a laccase, and/or peroxidase.

In general the properties of the selected enzyme(s) should be compatible with the selected detergent, (i.e., pH-optimum, compatibility with other enzymatic and non-enzymatic ingredients, etc.), and the enzyme(s) should be present in effective amounts.

Cellulases:

Suitable cellulases include those of bacterial or fungal origin. Chemically modified or protein engineered mutants are included. Suitable cellulases include cellulases from the genera *Bacillus, Pseudomonas, Humicola, Fusarium, Thielavia, Acremonium*, e.g., the fungal cellulases produced from *Humicola insolens, Myceliophthora thermophila* and *Fusarium oxysporum* disclosed in U.S. Pat. No. 4,435,307, U.S. Pat. No. 5,648,263, U.S. Pat. No. 5,691,178, U.S. Pat. No. 5,776,757 and WO 89/09259.

Especially suitable cellulases are the alkaline or neutral cellulases having color care benefits. Examples of such cellulases are cellulases described in EP 0 495 257, EP 0 531 372, WO 96/11262, WO 96/29397, WO 98/08940. Other examples are cellulase variants such as those described in WO 94/07998, EP 0 531 315, U.S. Pat. No. 5,457,046, U.S. Pat. No. 5,686,593, U.S. Pat. No. 5,763,254, WO 95/24471, WO 98/12307 and PCT/DK98/00299.

Example of cellulases exhibiting endo-beta-1,4-glucanase activity (EC 3.2.1.4) are those having described in WO02/099091.

Other examples of cellulases include the family 45 cellulases described in WO96/29397, and especially variants thereof having substitution, insertion and/or deletion at one or more of the positions corresponding to the following positions in SEQ ID NO: 8 of WO 02/099091: 2, 4, 7, 8, 10, 13, 15, 19, 20, 21, 25, 26, 29, 32, 33, 34, 35, 37, 40, 42, 42a, 43, 44, 48, 53, 54, 55, 58, 59, 63, 64, 65, 66, 67, 70, 72, 76, 79, 80, 82, 84, 86, 88, 90, 91, 93, 95, 95d, 95h, 95j, 97, 100, 101, 102, 103, 113, 114, 117, 119, 121, 133, 136, 137, 138, 139, 140a, 141, 143a, 145, 146, 147, 150e, 150j, 151, 152, 153, 154, 155, 156, 157, 158, 159, 160c, 160e, 160k, 161, 162, 164, 165, 168, 170, 171, 172, 173, 175, 176, 178, 181, 183, 184, 185, 186, 188, 191, 192, 195, 196, 200, and/or 20, preferably selected among P19A, G20K, Q44K, N48E, Q119H or Q146 R.

Commercially available cellulases include Celluzyme™, and Carezyme™ (Novozymes A/S), Clazinase™, and Puradax HA™ (Genencor International Inc.), and KAC-500 (B)™ (Kao Corporation).

Proteases:

The additional enzyme may be another protease or protease variant. The protease may be of animal, vegetable or microbial origin, including chemically or genetically modified mutants. Microbial origin is preferred. It may be an alkaline protease, such as a serine protease or a metalloprotease. A serine protease may for example be of the S1 family, such as trypsin, or the S8 family such as subtilisin. A metalloproteases protease may for example be a thermolysin from e.g. family M4, M5, M7 or M8.

The term "subtilases" refers to a sub-group of serine protease according to Siezen et al., Protein Engng. 4 (1991) 719-737 and Siezen et al. Protein Science 6 (1997) 501-523. Serine proteases are a subgroup of proteases characterized by having a serine in the active site, which forms a covalent adduct with the substrate. The subtilases may be divided into 6 sub-divisions, i.e. the Subtilisin family, the Thermitase family, the Proteinase K family, the Lantibiotic peptidase family, the Kexin family and the Pyrolysin family. In one aspect of the invention the protease may be a subtilase, such as a subtilisin or a variant hereof. Further the subtilases (and the serine proteases) are characterised by having two active site amino acid residues apart from the serine, namely a histidine and an aspartic acid residue.

Examples of subtilisins are those derived from Bacillus such as subtilisin lentus, Bacillus lentus, subtilisin Novo, subtilisin Carlsberg, Bacillus licheniformis, subtilisin BPN', subtilisin 309, subtilisin 147 and subtilisin 168 described in WO 89/06279 and protease PD138 (WO 93/18140). Additional serine protease examples are described in WO 98/020115, WO 01/44452, WO 01/58275, WO 01/58276, WO 03/006602 and WO 04/099401. An example of a subtilase variants may be those having mutations in any of the positions: 3, 4, 9, 15, 27, 36, 68, 76, 87, 95, 96, 97, 98, 99, 100, 101, 102, 103, 104, 106, 118, 120, 123, 128, 129, 130, 160, 167, 170, 194, 195, 199, 205, 217, 218, 222, 232, 235, 236, 245, 248, 252 and 274 using the BPN' numbering. More preferred the subtilase variants may comprise the mutations: S3T, V4I, S9R, A15T, K27R, *36D, V68A, N76D, N87S,R, *97E, A98S, S99G,D,A, S99AD, S101G, M,R S103A, V104I,Y,N, S106A, G118V,R, H120D,N, N123S, S128L, P129Q, S130A, G160D, Y167A, R170S, A194P, G195E, V199M, V205I, L217D, N218D, M222S, A232V, K235L, Q236H, Q245R, N252K, T274A (using BPN' numbering). A further preferred protease is the alkaline protease from Bacillus lentus DSM 5483, as described for example in WO 95/23221, and variants thereof which are described in WO 92/21760, WO 95/23221, EP 1921147 and EP 1921148.

Examples of trypsin-like proteases are trypsin (e.g. of porcine or bovine origin) and the Fusarium protease described in WO 89/06270 and WO 94/25583. Examples of useful proteases are the variants described in WO 92/19729, WO 98/20115, WO 98/20116, and WO 98/34946, especially the variants with substitutions in one or more of the following positions: 27, 36, 57, 76, 87, 97, 101, 104, 120, 123, 167, 170, 194, 206, 218, 222, 224, 235, and 274.

Examples of metalloproteases are the neutral metalloprotease as described in WO 07/044993.

Preferred commercially available protease enzymes include Alcalase™, Coronase™, Duralase™, Durazym™, Esperase™, Everlase™, Kannase™, Liquanase™, Liquanase Ultra™, Ovozyme™, Polarzyme™, Primase™, Relase™, Savinase and Savinase Ultra™, (Novozymes A/S), Axapem™ (Gist-Brocases N.V.), BLAP and BLAP X (Henkel AG & Co. KGaA), Excellase™, FN2™, FN3™, FN4™, Maxaca™, Maxapem™, Maxatase™, Properase™, Purafast™, Purafect™, Purafect OxP™, Purafect Prime™ and Puramax™ (Genencor int.).

Lipases and Cutinases:

Suitable lipases and cutinases include those of bacterial or fungal origin. Chemically modified or protein engineered mutant enzymes are included. Examples include lipase from Thermomyces, e.g. from T. lanuginosus (previously named Humicola lanuginosa) as described in EP258068 and EP305216, cutinase from Humicola, e.g. H. insolens (WO96/13580), lipase from strains of Pseudomonas (some of these now renamed to Burkholderia), e.g. P. alcaligenes or P. pseudoalcaligenes (EP218272), P. cepacia (EP331376), P. sp. strain SD705 (WO95/06720 & WO96/27002), P. wisconsinensis (WO96/12012), GDSL-type Streptomyces lipases (WO10/065455), cutinase from Magnaporthe grisea (WO10/107560), cutinase from Pseudomonas mendocina (U.S. Pat. No. 5,389,536), lipase from Thermobifida fusca (WO11/084412), Geobacillus stearothermophilus lipase (WO11/084417), lipase from Bacillus subtilis (WO11/084599), and lipase from Streptomyces griseus (WO11/150157) and S. pristinaespiralis (WO12/137147).

Further examples are lipases sometimes referred to as acyltransferases or perhydrolases, e.g. acyltransferases with homology to Candida antarctica lipase A (WO10/111143), acyltransferase from Mycobacterium smegmatis (WO05/56782), perhydrolases from the CE 7 family (WO09/67279), and variants of the M. smegmatis perhydrolase in particular the 554V variant used in the commercial product Gentle Power Bleach from Huntsman Textile Effects Pte Ltd (WO10/100028).

Other examples are lipase variants such as those described in EP407225, WO92/05249, WO94/01541, WO94/25578, WO95/14783, WO95/30744, WO95/35381, WO95/22615, WO96/00292, WO97/04079, WO97/07202, WO00/34450, WO00/60063, WO01/92502, WO07/87508 and WO09/109500.

Preferred commercial lipase products include Lipolase™, Lipex™; Lipolex™ and Lipoclean™ (Novozymes N/S), Lumafast (originally from Genencor) and Lipomax (originally from Gist-Brocades).

Amylases

The amylase may be an alpha-amylase, a beta-amylase or a glucoamylase and may be of bacterial or fungal origin. Chemically modified or protein engineered mutants are included. Amylases include, for example, alpha-amylases obtained from *Bacillus*, e.g., a special strain of *Bacillus licheniformis*, described in more detail in GB 1,296,839.

Examples of amylases are those having SEQ ID NO: 3 in WO 95/10603 or variants having 90% sequence identity to SEQ ID NO: 3 thereof. Preferred variants are described in WO 94/02597, WO 94/18314, WO 97/43424 and SEQ ID NO: 4 of WO 99/019467, such as variants with substitutions in one or more of the following positions: 15, 23, 105, 106, 124, 128, 133, 154, 156, 178, 179, 181, 188, 190, 197, 201, 202, 207, 208, 209, 211, 243, 264, 304, 305, 391, 408, and 444 of SEQ ID NO: 3 in WO 95/10603.

Further amylases which can be used are amylases having SEQ ID NO: 6 in WO 02/010355 or variants thereof having 90% sequence identity to SEQ ID NO: 6. Preferred variants of SEQ ID NO: 6 are those having a deletion in positions 181 and 182 and a substitution in position 193.

Other amylase examples are hybrid alpha-amylase comprising residues 1-33 of the alpha-amylase derived from *B. amyloliquefaciens* shown in SEQ ID NO: 6 of WO 2006/066594 and residues 36-483 of the *B. licheniformis* alpha-amylase shown in SEQ ID NO: 4 of WO 2006/066594 or variants having 90% sequence identity thereof. Preferred variants of this hybrid alpha-amylase are those having a substitution, a deletion or an insertion in one of more of the following positions: G48, T49, G107, H156, A181, N190, M197, I201, A209 and Q264. Most preferred variants of the hybrid alpha-amylase comprising residues 1-33 of the alpha-amylase derived from *B. amyloliquefaciens* shown in SEQ ID NO: 6 of WO 2006/066594 and residues 36-483 of SEQ ID NO: 4 are those having the substitutions:

M197T;
H156Y+A181T+N190F+A209V+Q264S; or
G48+T49+G107+H156+A181+N190+I201+A209+Q264.

Further amylase examples are amylases having SEQ ID NO: 6 in WO 99/019467 or variants thereof having 90% sequence identity to SEQ ID NO: 6. Preferred variants of SEQ ID NO: 6 are those having a substitution, a deletion or an insertion in one or more of the following positions: R181, G182, H183, G184, N195, I206, E212, E216 and K269. Particularly preferred amylases are those having deletion in positions G182 and H183 or positions H183 and G184.

Additional amylases are those having SEQ ID NO: 1, SEQ ID NO: 2 or SEQ ID NO: 7 of WO 96/023873 or variants thereof having 90% sequence identity to SEQ ID NO: 1, SEQ ID NO: 2 or SEQ ID NO: 7. Preferred variants of SEQ ID NO: 1, SEQ ID NO: 2 or SEQ ID NO: 7 are those having a substitution, a deletion or an insertion in one or more of the following positions: 140, 181, 182, 183, 184, 195, 206, 212, 243, 260, 269, 304 and 476. More preferred variants are those having a deletion in positions 182 and 183 or positions 183 and 184. Most preferred amylase variants of SEQ ID NO: 1, SEQ ID NO: 2 or SEQ ID NO: 7 are those having a deletion in positions 183 and 184 and a substitution in positions 140, 195, 206, 243, 260, 304 and 476.

Other amylases which can be used are amylases having SEQ ID NO: 2 of WO 08/153815, SEQ ID NO: 10 in WO 01/66712 or variants thereof having 90% sequence identity to SEQ ID NO: 2 of WO 08/153815 or 90% sequence identity to SEQ ID NO: 10 in WO 01/66712. Preferred variants of SEQ ID NO: 10 in WO 01/66712 are those having a substitution, a deletion or an insertion in one of more of the following positions: 176, 177, 178, 179, 190, 201, 207, 211 and 264.

Further amylases which can be used are amylases having SEQ ID NO: 2 of WO 09/061380 or variants thereof having 90% sequence identity to SEQ ID NO: 2. Preferred variants of SEQ ID NO: 2 are those having a substitution, a deletion or an insertion in one of more of the following positions: Q87, Q98, S125, N128, T131, T165, K178, R180, S181, T182, G183, M201, F202, N225, S243, N272, N282, Y305, R309, D319, Q320, Q359, K444 and G475. More preferred variants of SEQ ID NO: 2 are those having the substitution in one of more of the following positions: Q87E,R, Q98R, S125A, N128C, T131I, T165I, K178L, T182G, M201L, F202Y, N225E,R, N272E,R, S243Q,A,E,D, Y305R, R309A, Q320R, Q359E, K444E and G475K and/or deletion in position R180 and/or S181. Most preferred amylase variants of SEQ ID NO: 2 are those having the substitutions:

N128C+K178L+T182G+Y305R+G475K;
N128C+K178L+T182G+F202Y+Y305R+D319T+G475K;
S125A+N128C+K178L+T182G+Y305R+G475K; or
S125A+N128C+T131I+T165I+K178L+T182G+Y305R+G475K wherein the variant optionally further comprises a substitution at position 243 and/or a deletion at position 180 and/or position 181.

Other examples of amylases are the alpha-amylase having SEQ ID NO: 12 in WO01/66712 or a variant having at least 90%, such as at least 95%, sequence identity to SEQ ID NO: 12. Preferred amylase variants are those having a substitution, a deletion or an insertion in one of more of the following positions of SEQ ID NO: 12 in WO01/66712: R28, R118, N174; R181, G182, D183, G184, G186, W189, N195, M202, Y298, N299, K302, S303, N306, R310, N314; R320, H324, E345, Y396, R400, W439, R444, N445, K446, Q449, R458, N471, N484. Particular preferred amylases include variants having a deletion of D183 and G184 and having the substitutions R118K, N195F, R320K and R458K, and a variant additionally having substitutions in one or more position selected from the group: M9, G149, G182, G186, M202, T257, Y295, N299, M323, E345 and A339, most preferred a variant that additionally has substitutions in all these positions.

Commercially available amylases are Duramyl™, Termamyl™, Fungamyl™, Stainzyme™, Stainzyme Plus™, Natalase™ and BAN™ (Novozymes A/S), Rapidase™ and Purastar™ (from Genencor International Inc.).

Peroxidases/Oxidases:

Suitable peroxidases/oxidases include those of plant, bacterial or fungal origin. Chemically modified or protein engineered mutants are included. Examples of useful peroxidases include peroxidases from *Coprinus*, e.g., from *C. cinereus*, and variants thereof as those described in WO 93/24618, WO 95/10602, and WO 98/15257.

Commercially available peroxidases include Guardzyme™ (Novozymes N/S).

The detergent enzyme(s) may be included in a detergent composition by adding separate additives containing one or more enzymes, or by adding a combined additive comprising all of these enzymes. A detergent additive of the invention, i.e., a separate additive or a combined additive, can be formulated, for example, as a granulate, liquid, slurry, etc. Preferred detergent additive formulations are granulates, in particular non-dusting granulates, liquids, in particular stabilized liquids, or slurries.

Non-dusting granulates may be produced, e.g., as disclosed in U.S. Pat. Nos. 4,106,991 and 4,661,452 and may optionally be coated by methods known in the art. Examples of waxy coating materials are poly(ethylene oxide) products (polyethyleneglycol, PEG) with mean molar weights of 1000 to 20000; ethoxylated nonylphenols having from 16 to 50 ethylene oxide units; ethoxylated fatty alcohols in which the alcohol contains from 12 to 20 carbon atoms and in which there are 15 to 80 ethylene oxide units; fatty alcohols; fatty acids; and mono- and di- and triglycerides of fatty acids. Examples of film-forming coating materials suitable for application by fluid bed techniques are given in GB 1483591. Liquid enzyme preparations may, for instance, be stabilized by adding a polyol such as propylene glycol, a sugar or sugar alcohol, lactic acid or boric acid according to established methods. Protected enzymes may be prepared according to the method disclosed in EP 238,216.

Adjunct Materials

Any detergent components known in the art for use in laundry detergents may also be utilized. Other optional detergent components include anti-corrosion agents, anti-shrink agents, anti-soil redeposition agents, anti-wrinkling agents, bactericides, binders, corrosion inhibitors, disintegrants/disintegration agents, dyes, enzyme stabilizers (including boric acid, borates, CMC, and/or polyols such as propylene glycol), fabric conditioners including clays, fillers/processing aids, fluorescent whitening agents/optical brighteners, foam boosters, foam (suds) regulators, perfumes, soil-suspending agents, softeners, suds suppressors, tarnish inhibitors, and wicking agents, either alone or in combination. Any ingredient known in the art for use in laundry detergents may be utilized. The choice of such ingredients is well within the skill of the artisan.

Dispersants:

The detergent compositions of the present invention can also contain dispersants. In particular powdered detergents may comprise dispersants. Suitable water-soluble organic materials include the homo- or co-polymeric acids or their salts, in which the polycarboxylic acid comprises at least two carboxyl radicals separated from each other by not more than two carbon atoms. Suitable dispersants are for example described in Powdered Detergents, Surfactant science series volume 71, Marcel Dekker, Inc.

Dye Transfer Inhibiting Agents:

The detergent compositions of the present invention may also include one or more dye transfer inhibiting agents. Suitable polymeric dye transfer inhibiting agents include, but are not limited to, polyvinylpyrrolidone polymers, polyamine N-oxide polymers, copolymers of N-vinylpyrrolidone and N-vinylimidazole, polyvinyloxazolidones and polyvinylimidazoles or mixtures thereof. When present in a subject composition, the dye transfer inhibiting agents may be present at levels from about 0.0001% to about 10%, from about 0.01% to about 5% or even from about 0.1% to about 3% by weight of the composition.

Fluorescent Whitening Agent:

The detergent compositions of the present invention will preferably also contain additional components that may tint articles being cleaned, such as fluorescent whitening agent or optical brighteners. Where present the brightener is preferably at a level of about 0.01% to about 0.5%. Any fluorescent whitening agent suitable for use in a laundry detergent composition may be used in the composition of the present invention. The most commonly used fluorescent whitening agents are those belonging to the classes of diaminostilbene-sulphonic acid derivatives, diarylpyrazoline derivatives and bisphenyl-distyryl derivatives. Examples of the diaminostilbene-sulphonic acid derivative type of fluorescent whitening agents include the sodium salts of: 4,4'-bis-(2-diethanolamino-4-anilino-s-triazin-6-ylamino) stilbene-2,2'-disulphonate; 4,4'-bis-(2,4-dianilino-s-triazin-6-ylamino) stilbene-2,2'-disulphonate; 4,4'-bis-(2-anilino-4(N-methyl-N-2-hydroxy-ethylamino)-s-triazin-6-ylamino) stilbene-2,2'-disulphonate, 4,4'-bis-(4-phenyl-2,1,3-triazol-2-yl)stilbene-2,2'-disulphonate; 4,4'-bis-(2-anilino-4(1-methyl-2-hydroxy-ethylamino)-s-triazin-6-ylamino) stilbene-2,2'-disulphonate and 2-(stilbyl-4''-naphtho-1,2':4,5)-1,2,3-trizole-2''-sulphonate. Preferred fluorescent whitening agents are Tinopal DMS and Tinopal CBS available from Ciba-Geigy AG, Basel, Switzerland. Tinopal DMS is the disodium salt of 4,4'-bis-(2-morpholino-4 anilino-s-triazin-6-ylamino) stilbene disulphonate. Tinopal CBS is the disodium salt of 2,2'-bis-(phenyl-styryl)disulphonate. Also preferred are fluorescent whitening agents is the commercially available Parawhite KX, supplied by Paramount Minerals and Chemicals, Mumbai, India. Other fluorescers suitable for use in the invention include the 1-3-diaryl pyrazolines and the 7-alkylaminocoumarins. Suitable fluorescent brightener levels include lower levels of from about 0.01, from 0.05, from about 0.1 or even from about 0.2 wt % to upper levels of 0.5 or even 0.75 wt %.

Soil Release Polymers:

The detergent compositions of the present invention may also include one or more soil release polymers which aid the removal of soils from fabrics such as cotton and polyester based fabrics, in particular the removal of hydrophobic soils from polyester based fabrics. The soil release polymers may for example be nonionic or anionic terephthalate based polymers, polyvinyl caprolactam and related copolymers, vinyl graft copolymers, polyester polyamides see for example Chapter 7 in Powdered Detergents, Surfactant science series volume 71, Marcel Dekker, Inc. Another type of soil release polymers are amphiphilic alkoxylated grease cleaning polymers comprising a core structure and a plurality of alkoxylate groups attached to that core structure. The core structure may comprise a polyalkylenimine structure or a polyalkanolamine structure as described in detail in WO 2009/087523 (hereby incorporated by reference). Furthermore random graft co-polymers are suitable soil release polymers Suitable graft co-polymers are described in more detail in WO 2007/138054, WO 2006/108856 and WO 2006/113314 (hereby incorporated by reference). Other soil release polymers are substituted polysaccharide structures especially substituted cellulosic structures such as modified cellulose deriviatives such as those described in EP 1867808 or WO 2003/040279 (both are hereby incorporated by reference). Suitable cellulosic polymers include cellulose, cellulose ethers, cellulose esters, cellulose amides and mixtures thereof. Suitable cellulosic polymers include anionically modified cellulose, nonionically modified cellulose, cationically modified cellulose, zwitterionically modified cellulose, and mixtures thereof. Suitable cellulosic polymers include methyl cellulose, carboxy methyl cellulose, ethyl cellulose, hydroxyl ethyl cellulose, hydroxyl propyl methyl cellulose, ester carboxy methyl cellulose, and mixtures thereof.

Anti-Redeposition Agents:

The detergent compositions of the present invention may also include one or more anti-redeposition agents such as carboxymethylcellulose (CMC), polyvinyl alcohol (PVA), polyvinylpyrrolidone (PVP), polyoxyethylene and/or polyethyleneglycol (PEG), homopolymers of acrylic acid, copolymers of acrylic acid and maleic acid, and ethoxylated polyethyleneimines. The cellulose based polymers described under soil release polymers above may also function as anti-redeposition agents.

Other suitable adjunct materials include, but are not limited to, anti-shrink agents, anti-wrinkling agents, bactericides, binders, carriers, dyes, enzyme stabilizers, fabric softeners, fillers, foam regulators, hydrotropes, perfumes, pigments, sod suppressors, solvents, and structurants for liquid detergents and/or structure elasticizing agents.

Formulation of Detergent Products

The detergent composition of the invention may be in any convenient form, e.g., a bar, a homogenous tablet, a tablet having two or more layers, a pouch having one or more compartments, a regular or compact powder, a granule, a paste, a gel, or a regular, compact or concentrated liquid. There are a number of detergent formulation forms such as layers (same or different phases), pouches, as well as forms for machine dosing unit.

Pouches can be configured as single or multicompartments. It can be of any form, shape and material which is suitable for hold the composition, e.g. without allowing the release of the composition from the pouch prior to water contact. The pouch is made from water soluble film which encloses an inner volume. Said inner volume can be divided into compartments of the pouch. Preferred films are polymeric materials preferably polymers which are formed into a film or sheet. Preferred polymers, copolymers or derivates thereof are selected polyacrylates, and water soluble acrylate copolymers, methyl cellulose, carboxy methyl cellulose, sodium dextrin, ethyl cellulose, hydroxyethyl cellulose, hydroxypropyl methyl cellulose, malto dextrin, poly methacrylates, most preferably polyvinyl alcohol copolymers and, hydroxypropyl methyl cellulose (HPMC). Preferably the level of polymer in the film for example PVA is at least about 60%. Preferred average molecular weight will typically be about 20,000 to about 150,000. Films can also be of blend compositions comprising hydrolytically degradable and water soluble polymer blends such as polyactide and polyvinyl alcohol (known under the Trade reference M8630 as sold by Chris Craft In. Prod. Of Gary, Ind., US) plus plasticisers like glycerol, ethylene glycerol, Propylene glycol, sorbitol and mixtures thereof. The pouches can comprise a solid laundry cleaning composition or part components and/or a liquid cleaning composition or part components separated by the water soluble film. The compartment for liquid components can be different in composition than compartments containing solids. Ref: (US2009/0011970 A1).

Detergent ingredients can be separated physically from each other by compartments in water dissolvable pouches or in different layers of tablets. Thereby negative storage interaction between components can be avoided. Different dissolution profiles of each of the compartments can also give rise to delayed dissolution of selected components in the wash solution.

A liquid or gel detergent, which is not unit dosed, may be aqueous, typically containing at least 20% by weight and up to 95% water, such as up to about 70% water, up to about 65% water, up to about 55% water, up to about 45% water, up to about 35% water. Other types of liquids, including without limitation, alkanols, amines, diols, ethers and polyols may be included in an aqueous liquid or gel. An aqueous liquid or gel detergent may contain from 0-30% organic solvent. A liquid or gel detergent may be non-aqueous.

Laundry Soap Bars

The enzymes of the invention may be added to laundry soap bars and used for hand washing laundry, fabrics and/or textiles. The term laundry soap bar includes laundry bars, soap bars, combo bars, syndet bars and detergent bars. The types of bar usually differ in the type of surfactant they contain, and the term laundry soap bar includes those containing soaps from fatty acids and/or synthetic soaps. The laundry soap bar has a physical form which is solid and not a liquid, gel or a powder at room temperature. The term solid is defined as a physical form which does not significantly change over time, i.e. if a solid object (e.g. laundry soap bar) is placed inside a container, the solid object does not change to fill the container it is placed in. The bar is a solid typically in bar form but can be in other solid shapes such as round or oval.

The laundry soap bar may contain one or more additional enzymes, protease inhibitors such as peptide aldehydes (or hydrosulfite adduct or hemiacetal adduct), boric acid, borate, borax and/or phenylboronic acid derivatives such as 4-formylphenylboronic acid, one or more soaps or synthetic surfactants, polyols such as glycerine, pH controlling compounds such as fatty acids, citric acid, acetic acid and/or formic acid, and/or a salt of a monovalent cation and an organic anion wherein the monovalent cation may be for example $Na^+$, $K^+$ or $NH_4^+$ and the organic anion may be for example formate, acetate, citrate or lactate such that the salt of a monovalent cation and an organic anion may be, for example, sodium formate.

The laundry soap bar may also contain complexing agents like EDTA and HEDP, perfumes and/or different type of fillers, surfactants e.g. anionic synthetic surfactants, builders, polymeric soil release agents, detergent chelators, stabilizing agents, fillers, dyes, colorants, dye transfer inhibitors, alkoxylated polycarbonates, suds suppressers, structurants, binders, leaching agents, bleaching activators, clay soil removal agents, anti-redeposition agents, polymeric dispersing agents, brighteners, fabric softeners, perfumes and/or other compounds known in the art.

The laundry soap bar may be processed in conventional laundry soap bar making equipment such as but not limited to: mixers, plodders, e.g. a two stage vacuum plodder, extruders, cutters, logo-stampers, cooling tunnels and wrappers. The invention is not limited to preparing the laundry soap bars by any single method. The premix of the invention may be added to the soap at different stages of the process. For example, the premix containing a soap, an enzyme, optionally one or more additional enzymes, a protease inhibitor, and a salt of a monovalent cation and an organic anion may be prepared and the mixture is then plodded. The enzyme and optional additional enzymes may be added at the same time as the protease inhibitor for example in liquid form. Besides the mixing step and the plodding step, the process may further comprise the steps of milling, extruding, cutting, stamping, cooling and/or wrapping.

Granular Detergent Formulations

A granular detergent may be formulated as described in WO09/092699, EP1705241, EP1382668, WO07/001262, U.S. Pat. No. 6,472,364, WO04/074419 or WO09/102854. Other useful detergent formulations are described in WO09/124162, WO09/124163, WO09/117340, WO09/117341, WO09/117342, WO09/072069, WO09/063355, WO09/132870, WO09/121757, WO09/112296, WO09/112298, WO09/103822, WO09/087033, WO09/050026, WO09/047125, WO09/047126, WO09/047127, WO09/047128, WO09/021784, WO09/010375, WO09/000605, WO09/122125, WO09/095645, WO09/040544, WO09/040545, WO09/024780, WO09/004295, WO09/004294, WO09/121725, WO09/115391, WO09/115392, WO09/074398, WO09/074403, WO09/068501, WO09/065770, WO09/021813, WO09/030632, and WO09/015951.

WO2011025615, WO2011016958, WO2011005803, WO2011005623, WO2011005730, WO2011005844,

WO2011005904, WO2011005630, WO2011005830, WO2011005912, WO2011005905, WO2011005910, WO2011005813, WO2010135238, WO2010120863, WO2010108002, WO2010111365, WO2010108000, WO2010107635, WO2010090915, WO2010033976, WO2010033746, WO2010033747, WO2010033897, WO2010033979, WO2010030540, WO2010030541, WO2010030539, WO2010024467, WO2010024469, WO2010024470, WO2010025161, WO2010014395, WO2010044905,
WO2010145887, WO2010142503, WO2010122051, WO2010102861, WO2010099997, WO2010084039, WO2010076292, WO2010069742, WO2010069718, WO2010069957, WO2010057784, WO2010054986, WO2010018043, WO2010003783, WO2010003792,
WO2011023716, WO2010142539, WO2010118959, WO2010115813, WO2010105942, WO2010105961, WO2010105962, WO2010094356, WO2010084203, WO2010078979, WO2010072456, WO2010069905, WO2010076165, WO2010072603, WO2010066486, WO2010066631, WO2010066632, WO2010063689, WO2010060821, WO2010049187, WO2010031607, WO2010000636,

Method of Producing the Composition

The present invention also relates to methods of producing the composition. The method may be relevant for the (storage) stability of the detergent composition: e.g. Soap bar premix method WO2009155557.

Uses

The present invention is also directed to methods for using the compositions thereof. Said invention may be used for example in any application which requires the degradation of xanthan gum, such as in detergents and in the oil industry. In the oil industry xanthan gum is used for increasing the viscosity of the drilling fluid, in particular the drilling mud. In all such uses there will also be the need to decrease the viscosity by degrading the xanthan gum, and for such viscosity reduction a composition of the invention comprising a xanthan lyase and a GH 9 endoglucanase having activity on xanthan gum pretreated with xanthan lyase may suitable be used.

Use to Degrade Xanthan Gum

Xanthan gum has been use as an ingredient in many consumer products including foods and cosmetics and has found use in the oil industry. Therefore the degradation of xanthan gum can result in improved cleaning processes, such as the easier removal of stains containing gums, such as xanthan gum, as well as the degradation of xanthan gum which is often used in the oil and drilling industry. Thus the present invention is directed to the use of GH9 endoglucanases of the invention or compositions thereof to degrade xanthan gum. The present invention is also directed to the use of xanthan lyases of the invention or compositions thereof to degrade xanthan gum. An embodiment is the use of GH9 endoglucanases of the invention together with xanthan lyases of the invention or compositions thereof to degrade xanthan gum. Degradation of xanthan gum can preferably be measured using the viscosity reduction assay (ViPr assay) as described in example 6 or alternatively the reducing ends assay as described in Example 6 or the colourmetric assay as described in examples 25 and 26.

In an embodiment, degradation of xanthan gum may be measured using the viscosity reduction assay as described herein on xanthan gum. A preferred embodiment is the use of xanthan gum (0.25% or 0.5%) in buffer or water wherein the drop in viscosity is measured after 5 minutes, 30 minutes, 1 hour, 1.5 hours, 2 hours, 2.5 hours, 3 hours, 3.5 hours or 4 hours. A more preferred embodiment is the use of xanthan gum (0.25%) in water wherein the drop in viscosity is measured after 3 hours. The preferred enzyme concentration used for the GH9 endoglucanase and xanthan lyase is 31.25 mg EP/L and 31.25 mg EP/L respectively.

The drop in viscosity for the degradation of xanthan gum is at least 200 Pa when using the viscosity reduction assay. The drop in viscosity for the degradation of xanthan gum is at least 250 Pa when using the viscosity reduction assay. The drop in viscosity for the degradation of xanthan gum is at least 300 Pa when using the viscosity reduction assay. The drop in viscosity for the degradation of xanthan gum is at least 350 Pa when using the viscosity reduction assay. The drop in viscosity for the degradation of xanthan gum is at least 400 Pa when using the viscosity reduction assay. The drop in viscosity for the degradation of xanthan gum is at least 450 Pa when using the viscosity reduction assay. The drop in viscosity for the degradation of xanthan gum is at least 500 Pa when using the viscosity reduction assay. The drop in viscosity for the degradation of xanthan gum is at least 550 Pa when using the viscosity reduction assay. The drop in viscosity for the degradation of xanthan gum is at least 600 Pa when using the viscosity reduction assay.

GH9 endoglucanase activity may alternatively be measured reducing ends on xanthan gum pre-treated with xanthan lyase using the colorimetric assay developed by Lever (1972), Anal. Biochem. 47: 273-279, 1972. A preferred embodiment is the use of 0.1% xanthan gum pre-treated with xanthan lyase. Degradation of xanthan gum pre-treated with xanthan lyase may be determined by calculating difference between blank and sample wherein a difference of more than 0.5 mAU, preferably more than 0.6 mAU, more preferably more than 0.7 mAU or even more preferably more than 0.8 mAU shows degradation of xanthan gum pre-treated with xanthan lyase.

Xanthan lyase activity may alternatively be measured reducing ends on xanthan gum using the colorimetric assay developed by Lever (1972), Anal. Biochem. 47: 273-279, 1972. A preferred embodiment is the use of 0.1% xanthan gum. Degradation of xanthan gum may be determined by calculating difference between blank and sample wherein a difference of more than 0.1 mAU, preferably more than 0.15 mAU, more preferably more than 0.2 mAU or even more preferably more than 0.25 mAU shows degradation of xanthan gum.

GH9 endoglucanase and xanthan lyase activity may alternatively be measured reducing ends on xanthan gum using the colorimetric assay developed by Lever (1972), Anal. Biochem. 47: 273-279, 1972. A preferred embodiment is the use of 0.1% xanthan gum. Degradation of xanthan gum may be determined by calculating difference between blank and sample wherein a difference of more than 0.4 mAU, preferably more than 0.5 mAU, more preferably more than 0.6 mAU or even more preferably more than 0.8 mAU shows degradation of xanthan gum. The invention also relates to methods for degrading xanthan gum comprising applying a composition comprising one or more GH9 endoglucanases of the invention to xanthan gum. The invention further relates to methods for degrading xanthan gum comprising applying a composition comprising one or more xanthan lyases of the invention to xanthan gum. An embodiment is a method for degrading xanthan gum comprising applying a composition comprising one or more GH9 endoglucanases of the invention together with one or more xanthan lyases of the invention to xanthan gum.

Use in Detergents.

The present invention is directed to the use of GH9 endoglucanases of the invention or compositions thereof in cleaning processes such as the laundering of textiles and fabrics (e.g. household laundry washing and industrial laundry washing), as well as household and industrial hard surface cleaning, such as dish wash. The GH9 endoglucanases of the invention may be added to a detergent composition comprising of one or more detergent components.

The present invention is also directed to the use of xanthan lyases of the invention or compositions thereof in cleaning processes such as the laundering of textiles and fabrics (e.g. household laundry washing and industrial laundry washing), as well as household and industrial hard surface cleaning, such as dish wash. The xanthan lyases of the invention may be added to a detergent composition comprising of one or more detergent components.

An embodiment is the use of GH9 endoglucanases of the invention together with xanthan lyases of the invention or compositions thereof in cleaning processes such as the laundering of textiles and fabrics (e.g. household laundry washing and industrial laundry washing), as well as household and industrial hard surface cleaning, such as dish wash. The GH9 endoglucanases of the invention together with xanthan lyases of the invention may be added to a detergent composition comprising of one or more detergent components.

The polypeptides of the present invention may be added to and thus become a component of a detergent composition. The detergent composition of the present invention may be formulated, for example, as a hand or machine laundry detergent composition for both household and industrial laundry cleaning, including a laundry additive composition suitable for pre-treatment of stained fabrics and a rinse added fabric softener composition, or be formulated as a detergent composition for use in general household or industrial hard surface cleaning operations, or be formulated for hand or machine (both household and industrial) dishwashing operations. In a specific aspect, the present invention provides a detergent additive comprising a polypeptide of the present invention as described herein.

In an embodiment, the $\Delta$Int enzyme value may be measured using the AMSA as described herein on xanthan gum with carbon black swatches. A preferred embodiment is the use of xanthan gum with carbon black (DN31, DN31C or DN31D) swatches at 20° C. or at 40° C. A more preferred embodiment is the use of xanthan gum with carbon black (DN31C or DN31D) swatches at 40° C. An even more preferred embodiment is the use of xanthan gum with carbon black (DN31D) swatches at 40° C. The preferred enzyme concentration used for the GH9 endoglucanase and xanthan lyase is 0.5 mg EP/L and 1.0 mg EP/L respectively.

The delta intensity value for xanthan gum with carbon black swatch is at least 3 units as determined by AMSA. The delta intensity value for xanthan gum with carbon black swatch is at least 3.5 units as determined by AMSA. The delta intensity value for xanthan gum with carbon black swatch is at least 4 units as determined by AMSA. The delta intensity value for xanthan gum with carbon black swatch is at least 4.5 units as determined by AMSA. The delta intensity value for xanthan gum with carbon black swatch is at least 5 units as determined by AMSA. The delta intensity value for xanthan gum with carbon black swatch is at least 5.5 units as determined by AMSA. The delta intensity value for xanthan gum with carbon black swatch is at least 6 units as determined by AMSA. The delta intensity value for xanthan gum with carbon black swatch is at least 7 units as determined by AMSA. The delta intensity value for xanthan gum with carbon black swatch is at least 8 units as determined by AMSA. The delta intensity value for xanthan gum with carbon black swatch is at least 9 units as determined by AMSA. The delta intensity value for xanthan gum with carbon black swatch is at least 10 units as determined by AMSA.

In an embodiment, the $\Delta$Rem enzyme value may be measured using the MiniLOM assay as described herein on xanthan gum with carbon black swatches. A preferred embodiment is the use of xanthan gum with carbon black (DN31, DN31C or DN31D) swatches at 20° C. or at 40° C. A more preferred embodiment is the use of xanthan gum with carbon black (DN31C or DN31D) swatches at 40° C. An even more preferred embodiment is the use of xanthan gum with carbon black (DN31D) swatches at 40° C. The remission value is preferably measured at 460 nm. The preferred enzyme concentration used for the GH9 endoglucanase and xanthan lyase is 0.5 mg EP/L and 1.0 mg EP/L respectively.

The $\Delta$Rem enzyme value for xanthan gum with carbon black swatch is at least 1.5 units as determined by MiniLOM. The $\Delta$Rem enzyme value for xanthan gum with carbon black swatch is at least 1.75 units as determined by MiniLOM. The $\Delta$Rem enzyme value for xanthan gum with carbon black swatch is at least 2 units as determined by MiniLOM. The $\Delta$Rem enzyme value for xanthan gum with carbon black swatch is at least 2.25 units as determined by MiniLOM. The $\Delta$Rem enzyme value for xanthan gum with carbon black swatch is at least 2.5 units as determined by MiniLOM. The $\Delta$Rem enzyme value for xanthan gum with carbon black swatch is at least 2.75 units as determined by MiniLOM. The $\Delta$Rem enzyme value for xanthan gum with carbon black swatch is at least 3 units as determined by MiniLOM. The $\Delta$Rem enzyme value for xanthan gum with carbon black swatch is at least 3.5 units as determined by MiniLOM. The $\Delta$Rem enzyme value for xanthan gum with carbon black swatch is at least 4 units as determined by MiniLOM. The $\Delta$Rem enzyme value for xanthan gum with carbon black swatch is at least 4.5 units as determined by MiniLOM. The $\Delta$Rem enzyme value for xanthan gum with carbon black swatch is at least 5 units as determined by MiniLOM.

The invention also relates to methods for degrading xanthan gum on the surface of a textile or hard surface, such as dish wash, comprising applying a composition comprising one or more GH9 endoglucanases of the invention to xanthan gum. The invention further relates to methods for degrading xanthan gum on the surface of a textile or hard surface, such as dish wash, comprising applying a composition comprising one or more xanthan lyases of the invention to xanthan gum. An embodiment is a method for degrading xanthan gum on the surface of a textile or hard surface, such as dish wash, comprising applying a composition comprising one or more GH9 endoglucanases of the invention together with one or more xanthan lyases of the invention to xanthan gum. An embodiment is the composition comprising one or more detergent components as described herein. Use of GH9 endoglucanases having an enzyme detergency benefit It has surprisingly been found that the use of a GH9 alone gives an enzyme detergency benefit, preferably an enzyme detergency benefit on xanthan gum. This is surprising since endoglucanases are unable to significantly degrade the backbone of xanthan gum unless the xanthan gum has been pre-treated with xanthan lyase.

Thus another aspect of the invention is the use of a detergent composition comprising one or more detergent components and an isolated GH9 endoglucanase having an enzyme detergency benefit selected from the group consisting of
(a) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 2;
(b) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 10;
(c) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 12;
(d) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 14;
(e) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 48;
(f) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 52;
(g) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 56;
(h) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 82;
(i) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 86;
(j) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 90;
(k) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 94;
(l) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 98;
(m) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 102;
(n) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 130;
(o) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 134;
(p) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 138;
(q) a polypeptide encoded by a polynucleotide that hybridizes under medium stringency conditions, medium-high stringency conditions, high stringency conditions, or very high stringency conditions with:
  (i) the mature polypeptide coding sequence of SEQ ID NO: 1;
  (ii) the mature polypeptide coding sequence of SEQ ID NO: 9;
  (iii) the mature polypeptide coding sequence of SEQ ID NO: 11;
  (iv) the mature polypeptide coding sequence of SEQ ID NO: 13;
  (v) the mature polypeptide coding sequence of SEQ ID NO: 47;
  (vi) the mature polypeptide coding sequence of SEQ ID NO: 51;

(vii) the mature polypeptide coding sequence of SEQ ID NO: 55;
(viii) the mature polypeptide coding sequence of SEQ ID NO: 81;
(ix) the mature polypeptide coding sequence of SEQ ID NO: 85;
(x) the mature polypeptide coding sequence of SEQ ID NO: 89;
(xi) the mature polypeptide coding sequence of SEQ ID NO: 93;
(xii) the mature polypeptide coding sequence of SEQ ID NO: 97;
(xiii) the mature polypeptide coding sequence of SEQ ID NO: 101;
(xiv) the mature polypeptide coding sequence of SEQ ID NO: 129;
(xv) the mature polypeptide coding sequence of SEQ ID NO: 133;
(xvi) the mature polypeptide coding sequence of SEQ ID NO: 137; or
(xvii) the full-length complement thereof of (i), (ii), (iii), (iv), (v), (vi), (vii), (viii), (ix), (x), (xi), (xii), (xiii), (xiv), (xv), or (xvi);
(r) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 1;
(s) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 9;
(t) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 11;
(u) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 13;
(v) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 47;
(w) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 51;
(x) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 55;
(y) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 81;
(z) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 85;
(aa) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 89;
(ab) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 93;
(ac) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 97;
(ad) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 101;
(ae) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 129;

(af) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 133;

(ag) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 137;

(ah) a variant of the mature polypeptide of SEQ ID NO: 2, SEQ ID NO: 10, SEQ ID NO: 12, SEQ ID NO: 14, SEQ ID NO: 48, SEQ ID NO: 52, SEQ ID NO: 56, SEQ ID NO: 82, SEQ ID NO: 86, SEQ ID NO: 90, SEQ ID NO: 94, SEQ ID NO: 98, SEQ ID NO: 102, SEQ ID NO: 130, SEQ ID NO: 134 or SEQ ID NO: 138 comprising a substitution, deletion, and/or insertion at one or more positions (e.g. several); and (ai) a fragment of the polypeptide of (a), (b), (c), (d), (e), (f), (g), (h), (i), (j), (k), (l), (m), (n), (o), (p), (q), (r), (s), (t), (u), (v), (w), (x), (y), (z), (aa), (ab), (ac), (ad), (ae), (af), (ag) or (ah) that has activity on xanthan gum pretreated with xanthan lyase.

An embodiment is the use of a detergent composition comprising one or more detergent components and an isolated GH9 endoglucanase having an enzyme detergency benefit selected from the group consisting of (a) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 2;

(b) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 10;

(c) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 14;

(d) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 48;

(e) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 52;

(f) a polypeptide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide of SEQ ID NO: 56;

(g) a polypeptide encoded by a polynucleotide that hybridizes under medium stringency conditions, medium-high stringency conditions, high stringency conditions, or very high stringency conditions with:
  (i) the mature polypeptide coding sequence of SEQ ID NO: 1;
  (ii) the mature polypeptide coding sequence of SEQ ID NO: 9;
  (iii) the mature polypeptide coding sequence of SEQ ID NO: 13;
  (iv) the mature polypeptide coding sequence of SEQ ID NO: 47;
  (v) the mature polypeptide coding sequence of SEQ ID NO: 51;
  (vi) the mature polypeptide coding sequence of SEQ ID NO: 55;
  (vii) the full-length complement thereof of (i), (ii), (iii), (iv), (v) or (vi);

(h) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 1;

(i) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 9;

(j) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 13;

(k) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 47;

(l) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 51;

(m) a polypeptide encoded by a polynucleotide having at least 80%, e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the mature polypeptide coding sequence of SEQ ID NO: 55;

(n) a variant of the mature polypeptide of SEQ ID NO: 2, SEQ ID NO: 10, SEQ ID NO: 14, SEQ ID NO: 48, SEQ ID NO: 52 or SEQ ID NO: 56 comprising a substitution, deletion, and/or insertion at one or more positions (e.g. several); and (o) a fragment of the polypeptide of (a), (b), (c), (d), (e), (f), (g), (h), (i), (j), (k), (l), (m) or (n) that has activity on xanthan gum pretreated with xanthan lyase.

Another embodiment is the use of a detergent composition comprising one or more detergent components and an isolated GH9 endoglucanase of the invention together with a xanthan lyase. A preferred embodiment is the use of a detergent composition comprising one or more detergent components and an isolated GH9 endoglucanase of the invention together with a xanthan lyase of the invention.

Use in the Fracturing of a Subterranean Formation (Oil Drilling)

Hydraulic fracturing is used to create subterranean fractures that extend from the borehole into rock formation in order to increase the rate at which fluids can be produced by the formation. Generally, a high viscosity fracturing fluid is pumped into the well at sufficient pressure to fracture the subterranean formation. In order to maintain the increased exposure to the formation, a solid proppant is added to the fracturing fluid which is carried into the fracture by the high pressure applied to the fluid. Once the high viscosity fracturing fluid has carried the proppant into the formation, breakers are used to reduce the fluid's viscosity which allows the proppant to settle into the fracture and thereby increase the exposure of the formation to the well. Breakers work by reducing the molecular weight of the polymers, thus 'breaking' or degrading the polymer. The fracture then becomes a high permeability conduit for fluids and gas to be produced back to the well. Such processes are further disclosed in U.S. Pat. Nos. 7,360,593, 5,806,597, 5,562,160, 5,201,370 and 5,067,566.

Thus the invention relates to the use of GH9 endoglucanases of the invention as enzyme breakers. The invention also relates to the use of xanthan lyases of the invention as enzyme breakers. An embodiment of the invention is the use of GH9 endoglucanases of the invention together with xanthan lyases of the invention as enzyme breakers.

Accordingly, the invention provides a method for breaking xanthan gum in a well bore comprising: (i) blending together a gellable fracturing fluid comprising aqueous fluid, one or more hydratable polymers, suitable cross-linking agents for cross-linking the hydratable polymer to form a polymer gel and one or more enzymes of the invention (i.e. the enzyme breaker); (ii) pumping the cross-linked polymer gel into the well bore under sufficient pressure to fracture the surrounding formation; and (iii) allowing the enzyme breaker to degrade the cross-linked polymer to reduce the viscosity of the fluid so that the fluid can be pumped from the formation back to the well surface. As such, the GH9 endoglucanases of the invention can be used to control the viscosity of fracturing fluids. Furthermore, the xanthan lyases of the invention can be used to control the viscosity of fracturing fluids. In an embodiment, one or more GH9 endoglucanases of the invention together with one or more xanthan lyases of the invention can be used to control the viscosity of fracturing fluids.

The enzyme breaker of the present invention may be an ingredient of a fracturing fluid or a breaker-crosslinker-polymer complex which further comprises a hydratable polymer and a crosslinking agent. The fracturing fluid or complex may be a gel or may be gellable. The complex is useful in a method for using the complex in a fracturing fluid to fracture a subterranean formation that surrounds a well bore by pumping the fluid to a desired location within the well bore under sufficient pressure to fracture the surrounding subterranean formation. The complex may be maintained in a substantially non-reactive state by maintaining specific conditions of pH and temperature, until a time at which the fluid is in place in the well bore and the desired fracture is completed. Once the fracture is completed, the specific conditions at which the complex is inactive are no longer maintained. When the conditions change sufficiently, the complex becomes active and the breaker begins to catalyze polymer degradation causing the fracturing fluid to become sufficiently fluid to be pumped from the subterranean formation to the well surface.

Other Uses

The polypeptides of the present invention may additionally be used in other application where it is beneficial to remove xanthan gum.

Methods

Method of Degrading Xanthan Gum Wherein the Xanthan Gum is Used in Fracturing of a Subterranean Formation Perpetrated by a Well Bore When a well is drilled, reservoir drilling fluid (RDF) is circulated within the drilling equipment to cool down and clean the drill bit, remove the drill cuttings out of the well bore, reduce friction between the drill string and the sides of the borehole, and form a filtercake in order to prevent fluid leak off into the formation. The driving force for the formation of the filtercake is the higher wellbore pressure applied to maintain the borehole stability. This filtercake restricts the inflow of reservoir fluids into the wellbore during the drilling process and placement of the completion. If the filtercake damage that is created during the drilling process is not removed prior to or during completion of the well, a range of issues can arise when the well is put on production, i.e., completion equipment failures and impaired reservoir productivity.

Drilling fluid (mud), also called reservoir drilling fluid (RDF), can be synthetic/oil based or water based. To minimize invasion of the drilling fluid into the formation, both oil based and water based mud filtercakes typically contain a bridging or weighting agent, usually particles of calcium carbonate, barite or a mixture of the two, that bridge at the pore throats of the formation and thereby form a relatively low permeability filtercake. Both oil based and water based mud filtercakes also contain solids called cuttings that have been picked up during drilling, as opposed to the bridging/weighting agents that are added in the formulation of the drilling fluid. These solids can be quartz (sand), silts and/or shales, depending on the reservoir formation as well as the formations traversed by the drilling path to the reservoir. In addition, oil based drilling muds contain water droplets that become trapped in the pore space of the filtercake, while water based mud filtercakes contain polymers, such as starch and xanthan gum, and other inorganic salts.

The formation of a mud filtercake is often necessary for drilling, particularly in unconsolidated formations with wellbore stability problems and typically high permeabilities. The filtercake is then treated with various chemicals, such as chelants or acids to dissolve the calcite component; and/or enzymes or oxidizers to degrade the polymer component to recover permeability.

In one aspect, the invention provides a method for degrading xanthan gum wherein xanthan gum is used in fracturing of a subterranean formation perpetrated by a well bore by applying a composition comprising one of more enzymes of the invention. The method can include the steps of: (i) pumping a treatment fluid comprising one or more enzymes of the invention into the borehole in contact with the filtercake to be removed to establish a differential pressure between the treatment fluid and the formation adjacent the filtercake and (ii) evenly propagating treatment of the filtercake during the differential pressure period to delay breakthrough by the treatment fluid.

In one embodiment, the method can include establishing permeability through the treated filtercake between the formation and the borehole. In another embodiment, the filtercake can include drilling solids and clays, and may be formed from an aqueous drilling fluid. If desired, the treatment fluid for treating the aqueous drilling fluid filtercake can also include an oxidizer and/or a chelant, or it can be substantially free of chelant and oxidizer additives. In another example, the filtercake can be formed from an oil or invert emulsion drilling fluid. If desired, the treatment fluid for treating the oil or invert emulsion drilling fluid filtercake can also include a mutual solvent, a water-wetting agent or a combination thereof to disperse hydrophobic components in the filtercake.

In one embodiment, the treatment fluid comprises one or more GH9 endoglucanases of the invention. In another embodiment, the treatment fluid comprises one or more xanthan lyases of the invention. In a preferred embodiment, the treatment fluid comprises one or more GH9 endoglucanases and one or more xanthan lyases of the invention.

Method of Degrading Xanthan Gum Wherein the Xanthan Gum is a Component in Borehole Filtercake In one aspect, the invention provides a method for cleaning borehole filtercake, comprising polymers, such as xanthan gum and drilling fluid solids once the filtercake has been pumped to the surface. Drilling mud is pumped from mud pits to the drill bit and then back out to the surface, carrying out amongst other things crushed or cut rock (cuttings) in the process. The cuttings are filtered out and the mud is returned to the mud pits where fines can settle and/or chemicals or enzymes (breakers) can be added.

The method for degrading xanthan gum wherein the xanthan gum is a component in borehole filtercake can include the steps of (i) treating the borehole filtercake with a treatment fluid comprising one or more enzymes of the invention and (ii) separating the solids from the fluids. In one embodiment, the treatment fluid comprises one or more GH9 endoglucanases of the invention. In another embodiment, the treatment fluid comprises one or more xanthan lyases of the invention. In a preferred embodiment, the treatment fluid comprises one or more GH9 endoglucanases of the invention and one or more xanthan lyases of the invention.

The borehole filtercake may be treated in mud pits with one or more enzymes of the invention and the drilling fluid can be re-circulated. Alternatively, once the filtercake has been treated with one or more enzymes of the invention, the solids and fluid are separated using solid-liquid separation processes, such as centrifugation.

The present invention is further described by the following examples that should not be construed as limiting the scope of the invention.

EXAMPLES

Media and Solutions

YP+2% glucose medium was composed of 1% yeast extract, 2% peptone and 2% glucose.

PDA agar plates were composed of potato infusion (potato infusion was made by boiling 300 g of sliced (washed but unpeeled) potatoes in water for 30 minutes and then decanting or straining the broth through cheesecloth. Distilled water was then added until the total volume of the suspension was one liter, followed by 20 g of dextrose and 20 g of agar powder. The medium was sterilized by autoclaving at 15 psi for 15 minutes (Bacteriological Analytical Manual, 8th Edition, Revision A, 1998).

LB plates were composed of 10 g of Bacto-Tryptone, 5 g of yeast extract, 10 g of sodium chloride, 15 g of Bacto-agar, and deionized water to 1 liter. The medium was sterilized by autoclaving at 15 psi for 15 minutes (Bacteriological Analytical Manual, 8th Edition, Revision A, 1998).

COVE sucrose plates were composed of 342 g Sucrose (Sigma S-9378), 20 g Agar powder, 20 ml Cove salt solution (26 g $MgSO_4.7H_2O$, 26 g KCL, 26 g $KH_2PO_4$, 50 ml Cove trace metal solution) and deionized water to 1 liter), and deionized water to 1 liter). The medium was sterilized by autoclaving at 15 psi for 15 minutes (Bacteriological Analytical Manual, 8th Edition, Revision A, 1998). The medium was cooled to 60° C. and added 10 mM acetamide, 15 mM CsCl, Triton X-100 (50 µl/500 ml)).

Cove trace metal solution was composed of 0.04 g $Na_2B_4O_7.10H_2O$, 0.4 g $CuSO_4.5H_2O$, 1.2 g $FeSO_4.7H_2O$, 0.7 g $MnSO_4.H_2O$, 0.8 g $Na_2MoO_4.2H_2O$, 10 g $ZnSO_4.7H_2O$, and deionized water to 1 liter.

Dap-4C medium was composed of 20 g Dextrose, 10 g Maltose, 11 g $MgSO_4.7H_2O$, 1 g $KH_2PO_4$, 2 g Citric Acid, 5.2 g $K_3PO_4.H_2O$, 0.5 g Yeast Extract (Difco), 1 ml Dowfax 63N10 (Dow Chemical Company), 0.5 ml KU6 trace metals solution, 2.5 g $CaCO_3$, and deionized water to 1 liter. The medium was sterilized by autoclaving at 15 psi for 15 minutes (Bacteriological Analytical Manual, 8th Edition, Revision A, 1998). Before use, Dap-4C medium was added 3.5 ml sterile 50% $(NH_4)_2HPO_4$ and 5 ml sterile 20% Lactic Acid per 150 ml medium.

KU6 trace metals solution was composed of 0.13 g $NiCl_2$, 2.5 g $CuSO_4.5H_2O$, 13.9 g $FeSO_4.7H_2O$, 8.45 g $MnSO_4.H_2O$, 6.8 g $ZnCl_2$, 3 g Citric Acid, and deionized water to 1 liter.

TABLE 1

| Composition of Model Detergent A | |
|---|---|
| Detergent ingredients | Wt % |
| Linear alkylbenzenesulfonic acid (LAS) (Marlon AS3) | 13 |
| Sodium alkyl(C12)ether sulfate (AEOS) (STEOL CS-370 E) | 10 |
| Coco soap (Radiacid 631) | 2.75 |
| Soy soap (Edenor SJ) | 2.75 |
| Alcohol ethoxylate (AEO) (Bio-Soft N25-7) | 11 |
| Sodium hydroxide | 2 |
| Ethanol | 3 |
| Propane-1,2-diol (MPG) | 6 |
| Glycerol | 2 |
| Triethanolamine (TEA) | 3 |
| Sodium formate | 1 |
| Sodium citrate | 2 |

TABLE 1-continued

Composition of Model Detergent A

| Detergent ingredients | Wt % |
|---|---|
| Diethylenetriaminepentakis(methylenephosphonic acid) (DTMPA) | 0.2 |
| Polycarboxylate polymer (PCA) (Sokalan CP-5) | 0.2 |
| Water | Up to 100 |

Final adjustment of pH to pH 8 with NaOH or citric acid

TABLE 2

Composition of Model Liquid Detergent B

| Detergent ingredients | Wt % |
|---|---|
| Linear alkylbenzenesulfonic acid (LAS) | 7.2 |
| Sodium alkyl(C12)ether sulfate (AEOS) (SLES) | 4.2 |
| Coco soap (Radiacid 631) | 2.75 |
| Soy soap (Edenor SJ) | 2.75 |
| Alcohol ethoxylate (AEO) (Bio-Soft N25-7) | 6.6 |
| Sodium hydroxide | 1.2 |
| Ethanol | 3 |
| Propane-1,2-diol (MPG) | 6 |
| Glycerol | 2 |
| Triethanolamine (TEA) | 3 |
| Sodium formate | 1 |
| Sodium citrate | 2 |
| Diethylenetriaminepentakis(methylenephosphonic acid) (DTMPA) | 0.2 |
| Polycarboxylate polymer (PCA) (Sokalan CP-5) | 0.2 |
| Water | Up to 100 |

Wash Assays
Automatic Mechanical Stress Assay (AMSA) for Laundry

In order to assess the wash performance in laundry washing experiments are performed, using the Automatic Mechanical Stress Assay (AMSA). With the AMSA, the wash performance of a large quantity of small volume enzyme-detergent solutions can be examined. The AMSA plate has a number of wells for test solutions and a lid firmly squeezing the laundry sample, the textile to be washed against all the slot openings. During the washing time, the plate, test solutions, textile and lid are vigorously shaken at the controlled temperature to bring the test solution in contact with the textile and apply mechanical stress in a regular, periodic oscillating manner. For further description see WO02/42740 especially the paragraph "Special method embodiments" at page 23-24.

The wash performance is measured as the brightness of the colour of the textile washed. Brightness can also be expressed as the intensity of the light reflected from the sample when illuminated with white light. When the sample is stained the intensity of the reflected light is lower, than that of a clean sample. Therefore the intensity of the reflected light can be used to measure wash performance.

Colour measurements are made with a professional flat-bed scanner (Kodak iQsmart, Kodak, Midtager 29, DK-2605 Brøndby, Denmark, or Epson Expression 10000XL, Epson Danmark, Transformervej 6, 2730 Herlev, Denmark), which is used to capture an image of the washed textile.

To extract a value for the light intensity from the scanned images, 24-bit pixel values from the image are converted into values for red, green and blue (RGB). The intensity value (Int) is calculated by adding the RGB values together as vectors and then taking the length of the resulting vector:

$$Int = \sqrt{r^2 + g^2 + b^2}$$

Mini Launder-O-Meter (MiniLOM) Assay

The miniLOM assay is a small scale version of the Launder-O-Meter (LOM). It can be used to determine the "enzyme detergency benefit". A miniLOM basically consists of closed test tubes being rotated in a heating cabinet at a given time and temperature. Each test tube constitutes one small washing machine and during an experiment, each will contain a solution of a specific detergent/enzyme system to be tested along with the soiled and unsoiled fabrics it is tested on. Mechanical stress is achieved by the tubes being rotated and by including metal balls in the tube.

The small scale model wash system is mainly used in testing of detergents and enzymes at European wash conditions.

Evaluation of Stains from Mini-LOM

Wash performance is expressed as a remission value (Rem). After washing and rinsing the swatches were spread out flat and allowed to air dry at room temperature over night. All washes are evaluated shall be evaluated day 2 after wash. Light reflectance evaluations of the swatches were done using a Macbeth Color Eye 7000 reflectance spectrophotometer with very small aperture. The measurements were made without UV in the incident light and remission at 460 nm was extracted. Measurements were made on washed swatches. The test swatch to be measured was placed on top of another swatch of same type and colour (twin swatch). With only one swatch of each kind per beaker, a swatch from a replicate wash was used in this way. The enzyme performance can be seen by comparing the remission value of using no enzyme to the remission value using one or more enzymes. The higher the remission vale, the better the cleaning effect.

Activity Assays
Xanthan Lyase Activity Assay (Xanthan Lyase Specific Assay)

0.8 mL 100 mM HEPES buffer, pH 6.0 was mixed with 0.2 mL Xanthan gum (5 mg/mL) dissolved in water in a 1 mL 1 cm cuvette. The cuvette was inserted into a spectrophotometer (Agilent G1103A 8453A, CA, USA) with temperature control set at 40° C. The solution was pre-incubated for 10 min and 0.1 mL sample was added and the solution was mixed by aspirating and dispensing the solution for at least 5 times using a pipette. Total reaction volume was 1.1 mL. Absorbance at 235 nm was collected for 10 min using a 30 sec measuring interval. Initial activity was calculated by using the software (UV-Visible Chemstation Rev A.10.01 [81], Agilent).

Example 1

Identification of the GH9 Xanthanase Gene

Four bacterial strains were isolated from soil samples obtained from diverse places (see table 3 below) by using xanthan gum as sole carbon source.

TABLE 3

Isolation of bacterial strains

| Strain | Identification number | Source | Country |
|---|---|---|---|
| Paenibacillus sp | NN062047 | forest soil | China |
| Microbacterium sp | NN062149 | field soil | Spain |
| Microbacterium sp | NN062148 | sand beach | Denmark |
| Microbacterium sp | NN062045 | garden soil | Denmark |

Chromosomal DNA of four bacterial strains was isolated by QIAamp DNA Blood Mini Kit (Qiagen, Hilden, Germany). 2 ug of chromosomal DNA was subjected to partial shotgun genome sequencing, a service that is commercially available at FASTERIS SA, Switzerland. The genome sequence was analyzed for protein sequences that have glycosyl hydrolase domains (according to the CAZY definition above). One gene and corresponding protein sequence was identified from each bacterial strain (SEQ ID NO: 1, 9, 11, and 13) and proven here to in fact have the desired activity on xanthan gum.

Example 2

Cloning and Expression of GH9 in Bacillus subtilis with N-Terminal His Tag

The gene fragments of the GH9 gene were amplified from chromosomal DNA of the four bacterial strains with specific primers D88F-forward and D89R-reverse for Paenibacillus sp NN062047; D124F-forward and D125R-reverse for Microbacterium sp NN062149; D126F-forward and D127R-reverse for Microbacterium sp NN062148; D128F-forward and D129R-reverse for Microbacterium sp NN062045 (see table 4 for sequence details). The primers contain overhang to cloning vector, which is a derivative of the plasmid C6221 (described in WO2012/025577), modified by introducing a poly histidine tag (HHHHHHPR) after the secretion signal.

vated for subsequently DNA plasmid preparation. 7 clones of each construct were analyzed by DNA sequencing to verify the correct DNA sequence of the constructs. The nucleotide sequence of the fusion products corresponds to SEQ ID NO: 5, SEQ ID NO: 15, SEQ ID NO: 17 and SEQ ID NO: 19. The translated protein sequence corresponds to SEQ ID NO: 6, SEQ ID NO: 16, SEQ ID NO: 18 and SEQ ID NO: 20.

One clone with the correct recombinant gene sequence was selected and the corresponding plasmid was integrated by homologous recombination into the Bacillus subtilis host cell genome and the gene construct was expressed under the control of a triple promoter system as described in WO99/43835. The gene coding for chloramphenicol acetyltransferase was used as a marker (as described in Diderichsen et al., 1993, Plasmid 30:312-315).

Chloramphenicol resistant transformants were analyzed by PCR to verify the correct size of the amplified fragment. A recombinant B. subtilis clone containing the integrated expression construct was selected and grown in liquid culture. The enzyme containing supernatant was harvested and the enzyme was purified as described in Example 5.

Example 3

Identification, Genome Sequencing and Identification of the Xanthan Lyase Gene

The Paenibacillus strain NN018054 was isolated from a soil sample from New Zealand by using xanthan gum as sole

TABLE 4

Primers used for PCR amplification

| Amplification of GH9 gene of | Specific primer forward | Specific primer reverse |
|---|---|---|
| Paenibacillus sp NN062047 | D88F:<br>5'TCACCATCATCCTAGGATCGCAGG CGTGGTTCAAAGCGTGAATGTC 3'<br>(SEQ ID NO: 21) | D89R:<br>5'TTATTGATTAACGCGTTTACGGAA CTGGAACAAGCTGAATGAAATC 3'<br>(SEQ ID NO: 22) |
| Microbacterium sp NN062149 | D124F:<br>5'TCACCATCATCCTAGGGCGACGAT CGAACGCGTCGCCGTCA 3'<br>(SEQ ID NO: 23) | D125R:<br>5'TTATTGATTAACGCGTTCATCCGA CGACCACTCCGGTCACG 3'<br>(SEQ ID NO: 24) |
| Microbacterium sp NN062148 | D126F:<br>5'TCACCATCATCCTAGGGCGACGAT CACACAGGTCGCGGTGA 3'<br>(SEQ ID NO: 25) | D127R:<br>5'TTATTGATTAACGCGTCTACTGAA CGACCACCCCCGTCGTG 3'<br>(SEQ ID NO: 26) |
| Microbacterium sp NN062045 | D128F:<br>5'TCACCATCATCCTAGGGCCACCAT CGAGGAAGTCACGGTGA 3'<br>(SEQ ID NO: 27) | D129R:<br>5'TTATTGATTAACGCGTTCAGCCGA CGGCGACGCCGGACACC 3'<br>(SEQ ID NO: 28) |

The PCR fragments were cloned in the plasmid digested with AvrII and MluI enzymes using the In-Fusion HD cloning kit (Clontech product number 639648) following the instructions from the manufacturer (PT5162-1).

The GH9 polypeptide were expressed with the secretion signal with the following amino acid sequence (MKKPLG-KIVASTALLISVAFSSSIASA, (SEQ ID NO: 29)) replacing the native secretion signal resulting in the recombinant gene and protein sequence. (By doing so, the mature polypeptides were expressed with a poly histidine-tag (HHHHHHPR (SEQ ID NO: 30)) operably linked to the mature GH9 Xanthanase.

The In-Fusion reactions were transformed in E. coli and ampicillin resistant transformants were selected and culticarbon source. Chromosomal DNA of the bacterial strain Paenibacillus NN018054 was isolated by QIAamp DNA Blood Mini Kit" (Qiagen, Hilden, Germany). 2 ug of chromosomal DNA was sent for genome sequencing at FASTERIS SA, Switzerland. The genome was sequenced by Illumina Sequencing. The genome sequence was analyzed and the XL protein was identified (SEQ ID NO: 3) by BLASTP searches.

Example 4

Cloning and Expression of Xanthan Lyase in Bacillus subtilis with N-Terminal His Tag The truncated xanthan lyase gene was amplified from chromosomal DNA of the Paenibacillus strain NN018054 with gene specific primers (D117F: 5' TCACCATCATC-CTAGGGCGGAGGCGTCCGACATGTTCGACG 3' (SEQ ID NO: 31) (and D118R: 5' TTATTGATTAACGCGTT-TACGGCTGCTGCGCGCCGGTCAGG 3' (SEQ ID NO: 32)). The primers contain overhang to cloning vector, which is a derivative of the plasmid C6221 (described in WO2012/025577), modified by introducing a poly histidine tag (HH-HHHHPR (SEQ ID NO: 30)) after the secretion signal.

The PCR fragment was cloned in the plasmid digested with AvrII and MluI enzymes using the In-Fusion HD cloning kit (Clontech 639648) following the instructions from the manufacturer (PT5162-1).

The truncated xanthan lyase protein was expressed with the secretion signal with the following amino acid sequence (MKKPLGKIVASTALLISVAFSSSIASA, (SEQ ID NO: 29)) replacing the native secretion signal resulting in the recombinant gene and protein sequence SEQ ID NO: 7 and SEQ ID NO: 8. By doing so, the mature polypeptide was expressed with a poly histidine-tag (HHHHHHPR (SEQ ID NO: 30)) operably linked to the mature xanthan lyase.

The In-Fusion reaction was transformed in *E. coli* and the ampicillin resistant transformants were selected and cultivated for subsequently DNA plasmid preparation. 7 clones were analyzed by DNA sequencing to verify the correct DNA sequence of the construct. The nucleotide sequence of the fusion product corresponds to SEQ ID NO: 7. The translated protein sequence corresponds to SEQ ID NO: 8

One clone with the correct recombinant gene sequence was selected and the corresponding plasmid was integrated by homologous recombination into the *Bacillus subtilis* host cell genome. The gene construct was expressed under the control of a triple promoter system (as described in WO99/43835). The gene coding for chloramphenicol acetyltransferase was used as a marker (as described in Diderichsen et al., 1993, Plasmid 30:312-315)

Chloramphenicol resistant transformants were analyzed by PCR to verify the correct size of the amplified fragment. A recombinant *B. subtilis* clone containing the integrated expression construct was selected and grown in liquid culture. The enzyme containing supernatant was harvested and the enzyme was purified as described in Example 5.

Example 5

Purification of the GH9 and Xanthan Lyase Protein

A *Bacillus subtilis* strain was constructed as described in examples 2 and 4 to express the protein to the culture medium. The culture broth was centrifuged (17.696×g, 30 min) and the supernatant was carefully decanted from the precipitate. The supernatant was filtered through a Nalgene 0.2 µm filtration unit in order to remove the rest of the *Bacillus* host cells.

The volume was reduced using a Filtron system with 10K cut off filter. The volume was reduced to approx 80 mL, followed by addition of Buffer A: 50 mM TRIS+10 mM Imidazole pH 8.0 to the sample. The pH on the sample was adjusted to 8 and applied to a Ni-NTA Superflow column (QIAGEN) equilibrated in: Buffer A. After loading, the column is washed with Buffer A for 3 column volumes (CV). Then a step gradient to 100% Buffer B: Buffer B: 50 mM MES+10 mM Imidazole pH 7.0 was applied and consecutively a second gradient is applied up to 100% Buffer C: 50 mM MES+1 M Imidazole pH 7.0 in 4 CV. All the positive fractions are run on SDS-PAGE and the respective proteins are identified by the bands. The fractions containing XL or GH9 respectively were pooled and desalted into Buffer Tris 20 mM pH 7.0.

For further purification the respective pool was loaded into a Q-Sepharose Ion Exchange column (GE Healthcare) equilibrated in 20 mM Tris pH 7.0. After loading, the protein was eluted using 0-100% 20 mM Tris+1M NaCl, pH 7.0. The positive fractions were run on a SDS-PAGE Gel and desalted into 20 mM Tris pH 7.0.

The concentration of the purified proteins was determined by Absorbance at 280 using the respective extinction coefficients calculated from the deduced amino acids sequences of the mature proteins.

Example 6

Activity Screening of Xanthan Lyase and GH9 on Xanthan Gum

Xanthan Lyase Activity

Xanthan lyase activity was determined as described above on the purified xanthan lyase protein. The data is presented in the table 5 below.

TABLE 5

Specific Activity of Xanthan Lyase of SEQ ID NO: 8

| Conc xanthan lyase in cuvette (µg/mL) | Initial activity (mAU/min) | Specific activity (mAU/min/mg enzyme) |
|---|---|---|
| 0.291 | 17.274 | 4907 |
| 0.582 | 34.98 | 4969 |
| 1.455 | 94.32 | 5359 |

The data shows that the xanthan lyase had activity on xanthan gum.
Reducing Ends The method used to determine the amount of reducing ends produced was the 2,2' bicinchoninic acid assay (BCA) as described in Murphy et al., 2012, *J. Biol. Chem.* 287: 1252-1260 and adapted from Zhang et al, 2005, *Biomacromolecules* 6: 1510-1515 and Dubois et al, 1956, *Anal. Chem.* 28: 350-356. Quantification of reducing ends was based on a glucose standard curve. Appropriate substrate and enzyme controls were included and corrected for in each analysis. Appropriate dilutions were used to ensure samples were within the glucose calibration curve range. The results are shown in table 7 below.
Viscosity Reduction The viscosity measurements were performed using the Novozymes-developed viscosity pressure assay described in WO2011/107472. 100 µL of each 1 mL hydrolysis or control was the sample size. Results presented are the average of three measurements and are shown in table 6 below.
Hydrolysis The hydrolysis conditions were as follows: 40° C., 0.25% xanthan gum (XG) in 50 mM MES buffer+0.01% triton x-100 pH 7.0. Enzyme was added upon thermal equilibration. Prior to use all enzymes were buffer changed to the MES buffer using NAP 5 columns (GE Healthcare).
Enzyme Doses The purified enzyme preparations of example 5 were used for the analysis in following concentrations:
  GH9 (SEQ ID NO: 6): 7.25 mg/L
  Xanthan lyase (SEQ ID NO: 8): 40 µg/L

TABLE 6

Viscosity measurements of the GH9 (SEQ ID NO: 6) and/or Xanthan Lyase (SEQ ID NO: 8) on xantham gum

| | Incubation Time | | | | | |
|---|---|---|---|---|---|---|
| | 5 min | | 30 min | | 3 hours | |
| | Average (Pa) | S.D. | Average (Pa) | S.D. | Average (Pa) | S.D. |
| Buffer (control) | 586 | 49 | 508 | 15 | 541 | 17 |
| Xanthan gum (control) | 1039 | 15 | 1012 | 38 | 971 | 26 |
| Xanthan gum + GH 9 | 946 | 12 | 995 | 106 | 911 | 20 |
| Xanthan gum + xanthan lyase | 1023 | 20 | 1048 | 110 | 884 | 25 |
| Xanthan gum + xanthan lyase + GH 9 | 940 | 30 | 795 | 20 | 577 | 84 |

TABLE 7

Reducing Ends Results using GH9 (SEQ ID NO: 6) and/or Xanthan Lyase (SEQ ID NO: 8)

| Conditions | Incubation Time 3 hours μM glucose equivalents |
|---|---|
| Xanthan gum + GH 9 | 20 |
| Xanthan gum + xanthan lyase | 1312 |
| Xanthan gum + xanthan lyase + GH 9 | 2313 |

The above results from table 5 show that combination of xanthan lyase and GH9 can degrade xanthan gum by reducing the viscosity of the media. These results are in accordance with the results obtained from the reducing ends assay, shown in table 6, which shows that the number of reducing ends increases by the addition of xanthan lyase or xanthan lyase+GH 9, since the xanthan gum is degraded by the enzymes.

Example 7

Demonstration of Synergy Between GH9 Endoglucanase and Xanthan Lyase

A method using liquid chromatography was used to demonstrate the de-polymerizing effect of GH9 endoglucanase and xanthan lyase, having on xanthan gum. For this example the His-tagged xanthan lyase having SEQ ID NO: 8 and the His-tagged GH9 endoglucanase having SEQ ID NO: 6 were used. The enzymes were purified as described in example 5.

Substrate mixture consisting of 0.25% (w/v) xanthan gum (Keltron) in the reaction buffer 100 mM HEPES buffer, pH 6.0 supplemented with 0.01% (w/v) Triton-X was mixed with 0.02 mg/mL xanthan lyase and 0.02 mg/mL GH9. 50 μL samples were withdrawn at fixed time point and the samples were diluted with 150 μL HEPES buffer, pH 6.0. The sample was immediately injected using a 100 μL sample loop and separated on a 26 mL Superdex S200 column (GE Healthcare, Uppsala, Sweden). The system used in this experiment was an ÄKTA Explorer (GE healthcare) placed in a cold room (+4° C.). Separation of polysaccharides was conducted at a flow rate of 0.7 mL/min and using 0.1 M HEPES, pH 7.0 buffer. Absorbance at 235 nm was monitored to detect the double bond of the xanthan lyase reaction product. Two peaks could be observed in the chromatograms eluting at retention volumes 9 and 19 mL. A control sample consisting of 0.02 mg/mL xanthan lyase and 0.25% (w/v) xanthan gum incubated for 3 h in the reaction buffer only gave rise to a peak with retention volume of 9 mL. Thus, the peak appearing at 9 mL corresponded to xanthan lyase treated xanthan gum. Over time the 9 mL peak decreased while the peak eluting at 19 mL increased in size. The results are presented in table 8 below.

TABLE 8

Chromatographic results of GH9 (SEQ ID NO: 6) and Xanthan Lyase (SEQ ID NO: 8) on xanthan gum

| Time (min) | Peak height 9 mL (mAU) | Peak height 19 mL (mAU) |
|---|---|---|
| 3 | 36 | 5 |
| 40 | 20 | 15 |
| 85 | 11 | 20 |

The data indicated that the combination of xanthan lyase and the GH9 endoglucanase can degrade xanthan gum to smaller xanthan gum derived oligosaccharides.

Example 8

Specific Activity of Xanthan Lyase Treated Xanthan Gum Vs CMC

The method used to determine the specific activity for a GH9 endoglucanase was the p-hydroxybenzoic acid method (PHBAH). For this example the His-tagged GH9 endoglucanase derived from *Paenibacillus* sp. and having the sequence of SEQ ID NO: 6 was used.

Quantification of reducing ends was based on a glucose standard curve. The specific activity on carboxymethylcellulose 7LF (Hercules) was determined by using a substrate concentration of 1% w/v. The specific activity on xanthan lyase treated xanthan gum (prepared according to Nankai et al. (1999) from the source Keltran) was determined using a 0.25% w/v solution. Assay buffer was 0.1 M HEPES, pH 7.0. 1.5 mL substrate dissolved in the assay buffer was pre-heated in glass tubes for 5 min. 0.5 mL appropriate enzyme dilution was added and the sample was mixed by a vortex for 10 sec. The samples were incubated for 20 min at 40° C. The enzymatic reaction was terminated by adding 1.0 mL stop reagent consisting of 1.5 g PHBAH, 5 g K/Na tartrate dissolved in 100 mL 2% w/v NaOH. The samples were boiled for 10 min and 200 μL were transferred from each tube to a 96-hole microtiter plate. Absorbance at 410 nm was collected. Absorbance values were converted to IU by using the glucose standard curve. One IU is defined as the release of 1 μmol glucose equivalent formed per min at 40° C. and pH 7.0. The results are shown in table 9 below.

TABLE 9

Specific activity of the GH9 (SEQ ID NO: 6) on CMC compared to xanthan lyase treated xanthan gum

| Substrate | Specific activity (IU/mg) |
|---|---|
| CMC | 2.1 |
| Xanthan lyase treated xanthan gum | 41.5 |

The results show that the GH9 endoglucanase is more active on xanthan lyase treated xanthan gum compared to CMC.

Reference

Nankai, H., Hashimoto, W., Miki, H., Kawai, S., Murata, K. (1999) "Microbial system for polysaccharide depolymerization: enzymatic route for xanthan depolymerization by *Bacillus* sp. Strain GL1", Applied and Environmental Microbiology, Vol 65(6), p. 2520-2526.

Example 9

AMSA Wash Performance of Xanthan Lyase (SEQ ID NO: 8) and/or GH9 (SEQ ID NO: 6)

The experiments were conducted as described in the Automatic Mechanical Stress Assay (AMSA) for laundry method using a 2 cycle wash procedure and the experimental conditions specified in tables 10 and 11 below: The enzyme(s) as stated in tables 12 and 13 below were added in cycle 1.

TABLE 10

Conditions for Cycle 1

| Test solution | Buffer (50 mM MES) |
|---|---|
| Test solution volume | 160 micro L |
| pH | Adjusted to pH 7 |
| Wash time | 30 minutes |
| Temperature | 20° C. or 40° C. |
| Water hardness | 15° dH |
| $Ca^{2+}:Mg^{2+}:CO_3^{2-}$ ratio | 4:1:7.5 |
| Swatch | DN31: Xanthan gum with carbon black |

TABLE 11

Conditions for Cycle 2

| Test solution | 3.33 g/L model detergent A |
|---|---|
| Test solution volume | 160 micro L |
| pH | Unadjusted |
| Wash time | 30 minutes |
| Temperature | 20° C. or 40° C. |
| Water hardness | 15° dH |
| $Ca^{2+}:Mg^{2+}:CO_3^{2-}$ ratio | 4:1:7.5 |

Water hardness was adjusted by addition of $CaCl_2$, $MgCl_2$, and $NaHCO_3$ to the test system. After washing the textiles were flushed in tap water and air-dried. The swatches were prepared by adding xanthan gum from *Xanthomonas campestris* (Sigma cat #C1253) mixed with carbon black to a cotton fabric.

TABLE 12

Results of Xanthan Lyase (SEQ ID NO: 8) and/or GH9 (SEQ ID NO: 6) at 20° C. in AMSA assay.

| Enzyme(s) added (mg enzyme protein/ L wash solution) | Intensity (Avg) | Std dev |
|---|---|---|
| No enzyme added | 392.38 | 1.80 |
| Xanthan Lyase (1.0 mg EP/L) | 396.72 | 1.99 |
| GH9 (0.25 mg EP/L) | 398.46 | 1.51 |
| Xanthan Lyase (1.0 mg EP/L) & GH9 (0.25 mg EP/L) | 407.11 | 1.57 |

TABLE 13

Results of Xanthan Lyase (SEQ ID NO: 8) and/or GH9 (SEQ ID NO: 6) at 40° C. in AMSA assay

| Enzyme(s) added | Intensity (Avg) | Std dev |
|---|---|---|
| No enzyme added | 393.41 | 1.41 |
| Xanthan Lyase (1.0 mg EP/L) | 402.13 | 2.41 |
| GH9 (0.25 mg EP/L) | 401.56 | 1.24 |
| Xanthan Lyase (1.0 mg EP/L) & GH9 (0.25 mg EP/L) | 411.91 | 0.99 |

These results show that combination of xanthan lyase and GH9 has a washing effect under the conditions tested. Also GH9 alone performs well, whereas xanthan lyase alone only has minor effect in this assay.

Example 10

Xanthan Degrading Activity of GH9 Enzymes and Xanthan Lyase by Measurement of Viscosity Reduction Viscosity Reduction The viscosity measurements were performed using the Novozymes-developed viscosity pressure assay described in WO2011/107472. 400 μL was the sample size. Results presented are the average of three measurements and are shown in table 14 below.

Hydrolysis

The hydrolysis conditions were as follows: 30° C., 0.25% xanthan gum (XG) in 50 mM MES buffer+0.01% triton x-100 pH 7.0. Enzyme was added upon thermal equilibration. Prior to use all enzymes were buffer changed to the MES buffer using NAP 5 columns (GE Healthcare).

Enzyme Doses

The purified enzyme preparations of example 5 were used for the analysis at 31.25 mg/L. The enzyme mixtures of xanthan lyase (SEQ ID NO: 8) and GH9 endoglucanases were tested in duplicates.

TABLE 14

Viscosity measurements of different GH9's (SEQ ID NOs: 6, 16, 18 or 20) and/or Xanthan Lyase (XL, SEQ ID NO: 8) on xantham gum

| Sample | T = 0 minutes Average (Pa) | S.D | T = 30 minutes Average (Pa) | S.D | T = 1 hour Average (Pa) | S.D | T = 2 hours Average (Pa) | S.D | T = 3 hours Average (Pa) | S.D | T = 4 hours Average (Pa) | S.D |
|---|---|---|---|---|---|---|---|---|---|---|---|---|
| Xanthan Gum (control) | 935 | 40 | 905 | 29 | 1065 | 206 | 845 | 35 | 765 | 6 | 755 | 32 |
| Buffer control | 542 | 26 | 572 | 110 | 555 | 15 | 498 | 57 | 482 | 104 | 435 | 71 |
| Xanthan gum + xanthan lyase (XL) | 962 | 40 | 898 | 21 | 952 | 114 | 832 | 17 | 862 | 106 | 815 | 51 |
| Xanthan gum + GH9 (SEQ ID NO: 6) | 992 | 10 | 945 | 6 | 925 | 6 | 882 | 10 | 915 | 78 | 902 | 104 |
| Xanthan gum + GH9 (SEQ ID NO: 16) | 1042 | 10 | 985 | 15 | 1025 | 93 | 935 | 6 | 938 | 86 | 895 | 12 |
| Xanthan gum + GH9 (SEQ ID NO: 18) | 1048 | 25 | 1062 | 130 | 985 | 21 | 955 | 21 | 932 | 53 | 908 | 38 |
| Xanthan gum + GH9 (SEQ ID NO: 20) | 1042 | 20 | 1028 | 31 | 1038 | 98 | 942 | 20 | 912 | 20 | 855 | 47 |
| Xanthan gum + XL + GH9 (SEQ ID NO: 6) | 925 | 45 | 578 | 42 | 572 | 62 | 515 | 21 | 482 | 44 | 412 | 70 |
| Xanthan gum + XL + GH9 (SEQ ID NO: 16) | 975 | 97 | 628 | 12 | 625 | 75 | 502 | 30 | 418 | 21 | 408 | 71 |
| Xanthan gum + XL + GH9 (SEQ ID NO: 18) | 948 | 21 | 808 | 6 | 782 | 10 | 708 | 32 | 632 | 17 | 645 | 21 |
| Xanthan gum + XL + GH9 (SEQ ID NO: 20) | 908 | 15 | 712 | 17 | 668 | 31 | 592 | 20 | 592 | 70 | 472 | 0 |

The results presented above show that the combination of the different GH9 with xanthan lyase can degrade the xanthan present in the media, thus leading to viscosity reduction.

Example 11

Cloning and Expression of GH9 in *Bacillus subtilis* without N-Terminal His Tag

The gene fragments of the GH9 gene were amplified from chromosomal DNA of the four bacterial strains with specific primers D158F-forward and D159R-reverse for *Paenibacillus* sp NN062047; D168F-forward and D169R-reverse for *Microbacterium* sp NN062149; D170F-forward and D170R-reverse for *Microbacterium* sp NN062148; D171F-forward and D172R-reverse for *Microbacterium* sp NN062045 (see table 15 for sequence details). The primers contain overhang to cloning vector, C6221 (described in WO2012/025577), after the secretion signal.

TABLE 15

Primers used for PCR amplification

| Amplification of GH9 gene of | Specific primer forward | Specific primer reverse |
|---|---|---|
| *Paenibacillus* sp NN062047 | D158F: 5' GCTTTTAGTTCATCGATCGCATCGGC TATCGCAGGCGTGGTTCAAAGCGTG A 3' (SEQ ID NO: 33) | D159R: 5' TTATTGATTAACGCGTTTACGGA ACTGGAACAAGCTGAATGAAA 3' (SEQ ID NO: 34) |
| *Microbacterium* sp NN062149 | D168F: 5'GCTTTTAGTTCATCGATCGC ATCGGCTGCGACGATCGAACGCGTC GCCGTCA 3' (SEQ ID NO: 35) | D169R: 5' TTATTGATTAACGCGTTCATCCG ACGACCACTCCGGTCACG 3' (SEQ ID NO: 36) |
| *Microbacterium* sp NN062148 | D170F: 5' GCTTTTAGTTCATCGATCGCATCGGC TGCGACGATCACACAGGTCGCGGTG A 3' (SEQ ID NO: 37) | D170R: 5' TTATTGATTAACGCGTCTACTGA ACGACCACCCCGTCGTG 3' (SEQ ID NO: 38) |
| *Microbacterium* spNN062045 | D171F: 5' GCTTTTAGTTCATCGATCGCATCGGC TGCCACCATCGAGGAAGTCACGGTG A 3' (SEQ ID NO: 39) | D172R: 5' TTATTGATTAACGCGTTCAGCCG ACGGCGACGCCGGACACC 3' (SEQ ID NO: 40) |

The PCR fragment was cloned in the plasmid digested with ClaI and MluI enzymes using the In-Fusion HD cloning kit (Clontech product number 639648) following the instructions from the manufacturer (PT5162-1).

The GH9 protein was expressed with the secretion signal with the following amino acid sequence (MKKPLGKIVAS-TALLISVAFSSSIASA (SEQ ID NO: 29)) replacing the native secretion signal resulting in the recombinant gene and protein sequence.

The In-Fusion reaction was transformed in *E. coli* and ampicillin resistant transformants were selected and cultivated for subsequently DNA plasmid preparation. 7 clones were analyzed by DNA sequencing to verify the correct DNA sequence of the construct.

One clone with the correct recombinant gene sequence was selected and the corresponding plasmid was integrated by homologous recombination into the *Bacillus subtilis* host cell genome and the gene construct was expressed under the control of a triple promoter system as described in WO99/43835. The gene coding for chloramphenicol acetyltransferase was used as a marker (as described in Diderichsen et al., 1993, Plasmid 30:312-315).

Chloramphenicol resistant transformants were analyzed by PCR to verify the correct size of the amplified fragment.

Example 12

Cloning and Expression of Xanthan Lyase in *Bacillus subtilis* without N-Terminal His Tag The truncated xanthan lyase gene was amplified from chromosomal DNA of the *Paenibacillus* strain NN018054 with gene specific primers (D160F: 5' GCTTTTAGT-TCATCGATCGCATCGGCTGCGGAGGCGTCCGACAT-GTTCGACG 3' (SEQ ID NO: 41)) and D161R: 5' TTATT-GATTAACGCGTTTACGGCTGCTGCGCGCCGGTCAGG 3' (SEQ ID NO: 42)). The primers contain overhang to cloning vector, C6221 (described in WO2012/025577), after the secretion signal.

The PCR fragment was cloned in the plasmid digested with ClaI and MluI enzymes using the In-Fusion HD cloning kit (Clontech 639648) following the instructions from the manufacturer (PT5162-1).

The xanthan lyase protein was expressed with the secretion signal with the following amino acid sequence (MK-KPLGKIVASTALLISVAFSSSIASA, (SEQ ID NO: 29)) replacing the native secretion signal resulting in the recombinant gene and protein sequence.

The In-Fusion reaction was transformed in *E. coli* and ampicillin resistant transformants were selected and cultivated for subsequently DNA plasmid preparation. 7 clones were analyzed by DNA sequencing to verify the correct DNA sequence of the construct.

One clone with the correct recombinant gene sequence was selected and the corresponding plasmid was integrated by homologous recombination into the *Bacillus subtilis* host cell genome and the gene construct was expressed under the control of a triple promoter system as described in WO99/43835. The gene coding for chloramphenicol acetyltransferase was used as a marker (as described in Diderichsen et al., 1993, Plasmid 30:312-315).

Chloramphenicol resistant transformants were analyzed by PCR to verify the correct size of the amplified fragment.

Example 13

Construction of an *Aspergillus oryzae* Expression Vector Containing the Sequence Encoding a C-Terminal Truncated Xanthan Lyase Polypeptide Having Xanthanase Activity Two synthetic oligonucleotide primers shown below were designed to PCR amplify the xanthan lyase gene, having SEQ ID NO: 4, from the genomic DNA prepared from *Paenibacillus* sp. NN018054. An IN-FUSION™ Cloning Kit (BD Biosciences, Palo Alto, Calif., USA) was used to clone the fragment directly into the expression vector pDau109 (WO 2005/042735).

```
F-C3AQX
                                          (SEQ ID NO: 43)
5'-GGTGAAGCGTACGCGTGCGGAGGCGTCCGACATGTT-3'

R-C3AQX
                                          (SEQ ID NO: 44)
5'-AGATCTCGAGAAGCTTTTACGGCTGCTGCGCGCCGG-3'
```

Bold letters represent gene sequence. The underlined sequence is homologous to the insertion sites of pDau109.

An MJ Research PTC-200 DNA engine was used to perform the PCR reaction. A Phusion® High-Fidelity PCR Kit (Finnzymes Oy, Espoo, Finland) was used for the PCR amplification. The PCR reaction was composed of 4 µl of 5×GC buffer (Finnzymes Oy, Espoo, Finland), 0.4 µl of dNTPs (10 mM), 0.2 µl of Phusion® DNA polymerase (0.2 units/µl) (Finnzymes Oy, Espoo, Finland), 1 µl of primer F-C3AQX (10 µM), 1 µl of primer R-C3AQX (10 µM), 0.5 µl of genomic DNA (100 ng/µl), and 12.9 µl of deionized water in a total volume of 20 µl. The PCR conditions were 1 cycle at 98° C. for 1 minute. 30 cycles each at 98° C. for 10 seconds and 72° C. for 1.5 minutes; and 1 cycle at 72° C. for 5 minutes. The sample was then held at 10° C. until removed from the PCR machine.

The reaction products were isolated by 1.0% agarose gel electrophoresis using 40 mM Tris base, 20 mM sodium acetate, 1 mM disodium EDTA (TAE) buffer where a 2283 bp product band was excised from the gel and purified using an illustra GFX® PCR DNA and Gel Band Purification Kit (GE Healthcare Life Sciences, Brondby, Denmark) according to the manufacturer's instructions. The fragment was then cloned into Mlu I and Hind III digested pDau109 (WO 2005/042735) using an IN-FUSION™ Cloning Kit resulting in plasmid pC3AQX. Cloning of the C3AQX gene into Mlu I-Hind III digested pDau109 resulted in the transcription of the *Paenibacillus* sp-18054 C3AQX gene under the control of a NA2-tpi double promoter. The nucleotide sequence and deduced amino acid sequence of the *Paenibacillus* sp-18054 xanthan lyase C3AQX gene is shown in SEQ ID NO: 45 and SEQ ID NO: 46, respectively.

The cloning protocol was performed according to the IN-FUSION™ Cloning Kit instructions generating a C3AQX xanthan lyase construct. The treated plasmid and insert were transformed into One Shot® TOP10F' Chemically Competent *E. coli* cells (Invitrogen, Carlsbad, Calif., USA) according to the manufacturer's protocol and plated onto LB plates supplemented with 0.1 mg of ampicillin per ml. After incubating at 37° C. overnight, colonies were seen growing under selection on the LB ampicillin plates. Two colonies transformed with the C3AQX xanthan lyase construct were cultivated in LB medium supplemented with 0.1 mg of ampicillin per ml and plasmid was isolated with a QIAprep Spin Miniprep Kit (QIAGEN Inc., Valencia, Calif., USA) according to the manufacturer's protocol.

Isolated plasmids were sequenced with vector primers and C3AQX gene specific primers in order to determine a representative plasmid expression clone that was free of PCR errors.

Example 14

Expression of the *Paenibacillus* sp-18054 Xanthan Lyase in *Aspergillus*

The expression plasmid pC3AQX was transformed into *Aspergillus oryzae* MT3568. *Aspergillus oryzae* MT3568 is an AMDS (acetamidase) disrupted derivative of JaL355 (WO 2002/40694) in which pyrG auxotrophy was restored in the process of knocking out the *A. oryzae* acetamidase (AMDS) gene. MT3568 protoplasts are prepared according to the method of European Patent, EP0238023, pages 14-15, which are incorporated herein by reference.

Transformants were purified on COVE sucrose selection plates through single conidia prior to sporulating them on PDA plates. Production of the *Paenibacillus* sp-18054 xanthan lyase polypeptide by the transformants was analyzed from culture supernatants of 0.75 ml 96 deep well stationary cultivations at 30° C. in YP+2% glucose medium. Expression was verified on an E-Page 8% SDS-PAGE 48 well gel (Invitrogen, Carlsbad, Calif., USA) by Coomassie staining. One transformant was selected for further work and designated *Aspergillus oryzae* XL-4.

For larger scale production, *Aspergillus oryzae* XL-4 spores were spread onto a PDA plate and incubated for five days at 37° C. The confluent spore plate was washed twice with 5 ml of 0.01% TWEEN® 20 to maximize the number of spores collected. The spore suspension was then used to inoculate seven 500 ml flasks containing 100 ml of Dap-4C medium. The culture was incubated at 30° C. with constant shaking at 100 rpm. At day five post-inoculation, the culture broth was collected by filtration through a bottle top MF75 Supor MachV 0.2 μm PES filter (Thermo Fisher Scientific, Roskilde, Denmark). Fresh culture broth from this transformant produced a band of Xanthan lyase protein of approximately 90 kDa.

Strains

*Aspergillus oryzae* MT3568 strain was used for expression of the *Acremonium alcalophilum* gene encoding the polypeptide having endoglucanase activity. *A. oryzae* MT3568 is an amdS (acetamidase) disrupted gene derivative of *Aspergillus oryzae* JaL355 (WO 2002/40694) in which pyrG auxotrophy was restored by disrupting the *A. oryzae* acetamidase (amdS) gene.

Example 15

Activity Screening of Non-Tagged Xanthan Lyase (SEQ ID NO: 4) Expressed in *Aspergillus oryzae*

Filtered supernatant from a fermentation performed as described in example 14 was concentrated tenfold by a Vivaspin® 20 centrifugal column (Sartorius Stedim biotech, product number VS2092). Xanthan lyase activity in the concentrated sample was measured by viscosity reduction and reducing ends, as described in example 6 for the purified His-tagged enzymes.

Reducing Ends

The method used to determine the amount of reducing ends produced was the 2,2' bicinchoninic acid assay (BCA) as described in Murphy et al., 2012, *J. Biol. Chem.* 287: 1252-1260 and adapted from Zhang et al, 2005, *Biomacromolecules* 6: 1510-1515 and Dubois et al, 1956, *Anal. Chem.* 28: 350-356. Quantification of reducing ends was based on a glucose standard curve. Appropriate substrate and enzyme controls were included and corrected for in each analysis. Appropriate dilutions were used to ensure samples were within the glucose calibration curve range. The results are shown in table 17 below Viscosity Reduction The viscosity measurements were performed using the Novozymes-developed viscosity pressure assay described in WO2011/107472. 400 μL was the sample size. Results presented are the average of two measurements and are shown in table 16 below.

Hydrolysis

The hydrolysis conditions were as follows: 30° C., 0.25% xanthan gum (XG) in TY medium. Enzyme was added upon thermal equilibration.

Enzyme Doses

The purified enzyme preparations of example 5 were used for the analysis in the following final concentrations:

GH9 (SEQ ID NO: 6): 31.25 mg/L

Xanthan lyase (SEQ ID NO: 4): 31.25 mg/L

The concentration of xanthan lyase in the concentrated supernatant was estimated to be roughly similar to the purified enzyme based on SDS-page analysis.

TABLE 16

| | Viscosity measurements | | | | | | | |
|---|---|---|---|---|---|---|---|---|
| | T = 0 minutes | | T = 30 mins | | T = 1 hour | | T = 2 hours | |
| Sample | Average (Pa) | S.D | Average (Pa) | S.D | Average (Pa) | S.D | Average (Pa) | S.D |
| H₂O | 436 | 31 | 486 | 15 | 436 | 95 | 434 | 35 |
| Xanthan Gum (control) | 1293 | 30 | 1261 | 23 | 1220 | 43 | 1277 | 23 |
| Xanthan gum + xanthan lyase (SEQ ID NO: 4) + GH9 (SEQ ID NO: 6) | 1131 | 11 | 825 | 69 | 778 | 13 | 767 | 19 |
| Xanthan gum + host strain (concentrated supernant) | 1200 | 71 | 1333 | 42 | 1141 | 68 | 1224 | 80 |
| Xanthan gum + host strain (concentrated supernant) + GH9 (SEQ ID NO: 6) | 1125 | 36 | 1120 | 50 | 1071 | 53 | 1126 | 40 |
| Xanthan gum + xanthan lyase (concentrated supernatant) | 1225 | 80 | 1000 | 93 | 1040 | 5 | 1111 | 31 |

TABLE 16-continued

| | Viscosity measurements | | | | | | | |
|---|---|---|---|---|---|---|---|---|
| | T = 0 minutes | | T = 30 mins | | T = 1 hour | | T = 2 hours | |
| Sample | Average (Pa) | S.D | Average (Pa) | S.D | Average (Pa) | S.D | Average (Pa) | S.D |
| Xanthan gum + xanthan lyase (concentrated supernatant) + GH9 (SEQ ID NO: 6) | 1120 | 41 | 841 | 48 | 761 | 29 | 722 | 19 |
| Xanthan gum + DAP-4C growth media | 1185 | 53 | 1173 | 94 | 1180 | 66 | 1169 | 50 |

TABLE 17

| | Reducing Ends Results |
|---|---|
| Conditions | Incubation Time 30 min µM glucose equivalents |
| Xanthan gum + concentrated supernatant from *A. oryzae* host strain | 32 |
| Xanthan gum + concentrated supernatant containing xanthan lyase | 1451 |

The production of xanthan lyase in *Aspergillus oryzae* shows that the secreted xanthan lyase is active on xanthan gum alone, while the stable viscosity measurements for the same system show this to be an exo-enzyme action, having little effect on the bulk polymer backbone.

Example 16

Identification of New GH9 Xanthanases and XL Genes

Two new *paenibacillus* were isolated from soil samples (see table 18) following the same procedure as described in examples 1 and 3.

TABLE 18

| Isolation of bacterial strains | | | |
|---|---|---|---|
| Strain | Identification number | source | Country |
| *Paenibacillus* sp | NN062253 | forest soil | United States |
| *Paenibacillus* sp | NN062250 | forest soil | United States |

Chromosomal DNA extraction and genome sequencing of the two new strains was done as described in examples 1 and 3. The genes from the new bacterial strains as well as isolation of a new xanthan lyase and 2 truncated GH9 genes from *Paenibacillus* NN062047 and the corresponding protein sequences were identified and are presented in table 19.

TABLE 19

| Natural genes and corresponding polypeptide ID sequences | | |
|---|---|---|
| Amplification of gene from organism | SEQ ID NO of gene | SEQ ID NO of polypeptide |
| *Paenibacillus* NN062047 | 47 | 48 |
| *Paenibacillus* NN062047 | 51 | 52 |
| *Paenibacillus* NN062253 | 55 | 56 |
| *Paenibacillus* NN062250 | 59 | 60 |
| *Paenibacillus* NN062047 | 63 | 64 |

Example 17

Cloning and Expression of GH9 and Xanthan Lyase Candidates in *Bacillus subtilis* with N-Terminal His Tag The gene fragments (with the corresponding translated proteins) from example 16 were amplified from chromosomal DNA of the bacterial strains with specific primers (see table 20) and cloned and expressed in *Bacillus subtilis* with N-terminal poly histidine tag (HHHHHHPR-) after the secretion signal as described in example 2 and 4.

TABLE 20

| Primers used for PCR amplification | | | | |
|---|---|---|---|---|
| Amplification of gene from: | SEQ ID NO of polypeptide | | Specific primer forward | Specific primer reverse |
| *Paenibacillus* NN062047 | 50 | D244F | TCACCATCATCCTAGGGCAGGG ACCGTCAGCAAAATTTCCG (SEQ ID NO: 69) | D245R TTATTGATTAACGCGTTTAGG GTGTTGTTGCGCTAACCGGA (SEQ ID NO: 70) |
| *Paenibacillus* NN062047 | 54 | D242F | TCACCATCATCCTAGGGCAGGG ACCGTCAGCAAAATTTCCG (SEQ ID NO: 71) | D243R TTATTGATTAACGCGTTTAAG TCTGGTAGACCGCTGGTCCG (SEQ ID NO: 72) |

TABLE 20-continued

Primers used for PCR amplification

| Amplification of gene from: | SEQ ID NO of poly-peptide | Specific primer forward | Specific primer reverse |
|---|---|---|---|
| *Paenibacillus* NN062253 | 58 | D271F<br>TCACCATCATCCTAGGAACGCA<br>AGCCTGGTTCAAAGCGTGA<br>(SEQ ID NO: 73) | D272R<br>TTATTGATTAACGCGTTTAAG<br>GGGTCACGGAAACAAGCTGA<br>(SEQ ID NO: 74) |
| *Paenibacillus* NN062250 | 62 | D289F<br>TCACCATCATCCTAGGGCGGAT<br>GAATTCGACGGGATGCGGG<br>(SEQ ID NO: 75) | D290R<br>TTATTGATTAACGCGTTTACG<br>GATTACGTACAAATTTGACT<br>(SEQ ID NO: 76) |
| *Paenibacillus* NN062047 | 66 | D293F<br>TCACCATCATCCTAGGGCGGAC<br>GAGTTTGACACGCTAAGGG<br>(SEQ ID NO: 77) | D294R<br>TTATTGATTAACGCGTTTATG<br>GGACCTTTACCAGCTTCACG<br>(SEQ ID NO: 78) |
| *Paenibacillus* NN018054 | 68 | D332F<br>TCACCATCATCCTAGGGCGGAG<br>GCGTCCGACATGTTCGACG<br>(SEQ ID NO: 79) | D333R<br>TTATTGATTAACGCGTTCAGT<br>CGAGCCAGATGTAATCAAGC<br>(SEQ ID NO: 80) |

Example 18

AMSA Wash Performance of Xanthan Lyase and GH9

The experiments were conducted as described in the Automatic Mechanical Stress Assay (AMSA) for laundry method using a single cycle wash procedure and the experimental conditions specified in table 21 below. The results are given in tables 22 and 23 using 6 different GH9 endoglucanases and 4 different xanthan lyases along with controls where either the GH9 endoglucanase and/or xanthan lyase are absent. The results are shown as the ΔInt enzyme value.

TABLE 21

| Experimental conditions for Wash Cycle | |
|---|---|
| Test solution | 3.33 g/L Model liquid detergent B |
| Test solution volume | 140 μL detergent per slot; 20 μL enzyme per slot |
| pH | Unadjusted |
| Wash time | 20 minutes |
| Temperature | 20° C. or 40° C. |
| Enzyme dosage | Xanthan lyase: 1 mg EP/L<br>GH9: 0.5 mg EP/L |
| Water hardness | 16° dH |
| $Ca^{2+}:Mg^{2+}:CO_3^{2-}$ ratio | 5:1:3 |
| Swatch | DN31D. Xanthan gum with carbon black |

Water hardness was adjusted by addition of $CaCl_2$, $MgCl_2$, and $NaHCO_3$ to the test system. After washing the textiles were flushed in tap water and air-dried. The swatches were prepared by adding xanthan gum from *Xanthomonas campestris* (Food Grade Keltrol T, Kelco) mixed with carbon black to a cotton fabric.

TABLE 22

Compiled AMSA wash data using model liquid detergent B at 40° C.

| ΔInt enzyme value GH9 | Xanthan Lyase | | | |
|---|---|---|---|---|
| | No XL | SEQ ID NO: 8 | SEQ ID NO: 62 | SEQ ID NO: 66 | SEQ ID NO: 68 |
| SEQ ID NO: 2[1] | 9.6 | 17.8 | ND[2] | ND[2] | ND[2] |
| SEQ ID NO: 6 | 13.8 | 25.5 | 22.8 | 30.1 | 22.0 |
| SEQ ID NO: 16 | 8.6 | 18.9 | 17.7 | 20.8 | 15.5 |
| SEQ ID NO: 20 | 7.9 | 13.5 | 13.7 | 13.2 | 13.2 |
| SEQ ID NO: 50 | 12.8 | 22.6 | 19.5 | 25.5 | 18.5 |
| SEQ ID NO: 54 | 4.6 | 14.6 | 12.3 | 18.1 | 13.3 |
| SEQ ID NO: 58 | 10.2 | 14.4 | 13.1 | 15.0 | 15.8 |
| No GH9 (Control) | 0 | 1.7 | 0.5 | 3.8 | −1.4 |

[1]Quantification of SEQ ID NO: 2 uncertain due to a second closely running band present in the SDS-gel.
[2]Not determined

TABLE 23

Compiled AMSA wash data using model liquid detergent B at 20° C.

| ΔInt enzyme value GH9 | Xanthan Lyase | | | |
|---|---|---|---|---|
| | No XL | SEQ ID NO: 8 | SEQ ID NO: 62 | SEQ ID NO: 66 | SEQ ID NO: 68 |
| SEQ ID NO: 2[1] | 4.7 | 7.0 | ND[2] | ND[2] | ND[2] |
| SEQ ID NO: 6 | 10.6 | 16.6 | 19.1 | 22.8 | 15.1 |
| SEQ ID NO: 16 | 5.0 | 14.6 | 14.5 | 15.0 | 9.5 |
| SEQ ID NO: 20 | 3.1 | 10.6 | 9.9 | 9.6 | 6.4 |
| SEQ ID NO: 50 | 8.6 | 16.9 | 15.2 | 17.2 | 11.0 |
| SEQ ID NO: 54 | 3.7 | 13.7 | 13.0 | 14.4 | 9.8 |
| SEQ ID NO: 58 | 8.8 | 14.1 | 13.3 | 12.7 | 10.2 |
| No GH9 (Control) | 0 | 5.0 | 3.7 | 3.5 | 1.8 |

[1]Quantification of SEQ ID NO: 2 uncertain due to a second closely running band present in the SDS-gel.
[2]Not determined These results show that different combinations of GH9 endoglucanases and xanthan lyases give a synergistic wash effect on xanthan gum with carbon black stains at both 20° C. and 40° C., thus indicating that this synergistic effect can be extrapolated to all xanthan lyases and all GH9 endoglucanases.

Example 19

MiniLOM Wash Performance of Xanthan Lyase (SEQ ID NO: 8) and/or GH9 (SEQ ID NO: 6, 16, 50, 54 or 58)

The enzymes of the present invention were tested using the miniLOM assay in order to determine the "enzyme detergency effect". Test tubes are filled with test solution, soiled fabrics and steel balls and rotated in a heating cabinet at a given temperature. Cleaning benefits are studied when washing in either buffer or model liquid detergent A. The experimental conditions for the experiments are specified in Table 24.

TABLE 24

Experimental conditions for MiniLOM

| | |
|---|---|
| Test solution | Model liquid detergent A |
| Test solution volume | 40 mL |
| pH | Not adjusted |
| Wash time | 30 minutes |
| Temperature | 40° C. |
| Water hardness | 16° dH |
| $Ca^{2+}:Mg^{2+}:CO_3^{2-}$ ratio | 5:1:3 |
| Enzyme dosage | Xanthan lyase: 1 mg EP/L |
| | GH9: 0.5 mg EP/L |
| Swatches | Circular swatches 2 cm in diameter |
| Stains | 4 x Technical stains with Xanthan Gum with Carbon Black (DN31D) |
| Ballast | 6 x wfk10A (100% woven cotton) |
| | 6 x wfk80A (100% knitted cotton) |
| Total ballast weight | Technical stains: 0.43 g |
| | Ballast stains: 0.53 g pr tube |
| Mechanics | 4 stainless steel balls, 6 mm in diameter |

Water hardness was adjusted by addition of $CaCl_2$, $MgCl_2$, and $NaHCO_3$ to the test system. After washing the textiles were flushed in tap water and air-dried. The swatches were prepared by adding xanthan gum from *Xanthomonas campestris* (Food Grade Keltrol T, Kelco) mixed with carbon black to a cotton fabric.

The performance of the enzyme(s) is evaluated by measuring the remission of the textile swatches using the ColorEye at 460 nm.

TABLE 25

Results of MimiLOM Wash using 5 different GH9s and/or Xanthan Lyase (SEQ ID NO: 8)

| SEQ ID NO of GH9 endoglucanase | $Rem_{460}$ | | | |
|---|---|---|---|---|
| | No Enzyme | XL | GH9 | XL + GH9 |
| SEQ ID NO: 6 | 40.4 ± 1.3 | 40.3 ± 1.3 | 48.1 ± 0.5 | 49.8 ± 0.5 |
| SEQ ID NO: 16 | 40.9 ± 3.2 | 40.2 ± 2.5 | 45.6 ± 0.4 | 47.9 ± 0.6 |
| SEQ ID NO: 50 | 40.6 ± 2.3 | 40.4 ± 1.7 | 45.6 ± 0.7 | 47.8 ± 0.7 |
| SEQ ID NO: 54 | 40.1 ± 2.0 | 40.8 ± 2.7 | 45.4 ± 1.3 | 47.0 ± 0.9 |
| SEQ ID NO: 58 | 41.1 ± 0.6 | 40.8 ± 2.2 | 47.3 ± 0.4 | 46.6 ± 0.3 |

These results show that adding the GH9 endoglucanase (all five variants) to the wash gives a significant cleaning benefit under the conditions tested. Furthermore, adding the GH9 endoglucanase (all five variants) together with XL results in an additional wash effect even though the xanthan lyase on its own has no apparent effect.

Example 20

Identification of the GH9 Xanthanase and Xanthan Lyase Genes

Six new *paenibacillus* sp were isolated from soil samples (see table 26) following the same procedure as described in examples 1 and 3.

TABLE 26

Identification of Bacterial Strains

| Strain | Identification number | Source | Country |
|---|---|---|---|
| Paenibacillus sp | NN062046 | Forest soil | China |
| Paenibacillus sp | NN062408 | Soil | Denmark |
| Paenibacillus sp | NN062332 | Soil | United States |
| Paenibacillus sp | NN062147 | Sand beach | Denmark |
| Paenibacillus sp | NN062193 | Garden soil | Denmark |
| Microbacterium sp | NN062175 | Soil | Denmark |

Chromosomal DNA extraction and genome sequencing of the six new strains was done as described in examples 1 and 3. The genes from the new bacterial strains as well as isolation of 6 new xanthan lyases and 8 GH9 genes and the corresponding protein sequences were identified and are presented in table 27.

TABLE 27

Natural genes and corresponding polypeptide ID sequences

| Amplification of gene from organism | SEQ ID NO of gene | SEQ ID NO of polypeptide |
|---|---|---|
| Paenibacillus NN062046 | 81 | 82 |
| Paenibacillus NN018054 | 85 | 86 |
| Paenibacillus NN062408 | 89 | 90 |
| Paenibacillus NN018054 | 93 | 94 |
| Paenibacillus NN062332 | 97 | 98 |
| Paenibacillus NN062147 | 105 | 106 |
| Paenibacillus NN062193 | 109 | 110 |
| Paenibacillus NN062408 | 113 | 114 |
| Paenibacillus NN062332 | 117 | 118 |
| Paenibacillus NN062046 | 121 | 122 |
| Paenibacillus NN062253 | 125 | 126 |
| Microbacterium NN062175 | 129 | 130 |
| Paenibacillus NN062193 | 133 | 134 |
| Paenibacillus NN062193 | 137 | 138 |

Example 21

Cloning and Expression of GH9 and Xanthan Lyase Candidates in *Bacillus subtilis* with N-Terminal His Tag The gene fragments (with the corresponding translated proteins) from example 20 were amplified from chromosomal DNA of the bacterial strains with specific primers (see table 28) and cloned and expressed in *Bacillus subtilis* with N-terminal poly histidine tag (HHHHHHPR-) after the secretion signal as described in example 2 and 4.

TABLE 28

Primers used for PCR amplification

| Amplification of gene from: | SEQ ID NO of recombinant gene | SEQ ID NO of polypeptide | Specific primer forward | Specific primer reverse |
|---|---|---|---|---|
| Paenibacillus NN062046 | 83 | 84 | F-C597B TCACCATCATCCTAGGGCCG TAGCCCCGCTCCCC (SEQ ID NO: 141) | R-C597B TTATTGATTAACGCGTTTA TGGCGTCGTTACGAGGAA (SEQ ID NO: 142) |
| Paenibacillus NN018054 | 95 | 96 | F-C5B9G TCACCATCATCCTAGGGCTC CGGCTCCGCTGCCG (SEQ ID NO: 143) | R-C5B9G TTATTGATTAACGCGTTTA GCCCCGCACCGTCACATC (SEQ ID NO: 144) |
| Paenibacillus NN062332 | 99 | 100 | F-C59T2 TCACCATCATCCTAGGGCCG TGCCGCCGTTGCCG (SEQ ID NO: 145) | R-C59T2 TTATTGATTAACGCGTCTA ACTTGGCGTGACGGT (SEQ ID NO: 146) |
| Paenibacillus NN062147 | 107 | 108 | F-C4AM9 TCACCATCATCCTAGGGCAG ACGAATTCGATGCAATGAGGG (SEQ ID NO: 147) | R-C4AM9 TTATTGATTAACGCGTTTA CGGCACGAATTCAAACTTG ACC (SEQ ID NO: 148) |
| Paenibacillus NN062193 | 111 | 112 | F-C4AKF TCACCATCATCCTAGGTCAGA TGAATATGATACGATGCGGG (SEQ ID NO: 149) | R-C4AKF TTATTGATTAACGCGTCTA AGAGCCTGGCGCCACATA TTCA (SEQ ID NO: 150) |
| Paenibacillus NN062408 | 115 | 116 | F-C59TM TCACCATCATCCTAGGTCCGA CGCGTATGATGCA (SEQ ID NO: 151) | R-C59TM TTATTGATTAACGCGTCTA CTGGATCAACTCAAACTT (SEQ ID NO: 152) |
| Paenibacillus NN062332 | 119 | 120 | F-C59SY TCACCATCATCCTAGGGGCG GCGAAGCGAGCGGG (SEQ ID NO: 153) | R-C59SY TTATTGATTAACGCGTTTA CGGCACATATTCAAATTTG (SEQ ID NO: 154) |
| Paenibacillus NN062046 | 123 | 124 | F-C3AX4 TCACCATCATCCTAGGGCGG ACGAATACGACACGATTAGGG (SEQ ID NO: 155) | R-C3AX4 TTATTGATTAACGCGTTTA TTCGCTGTAAATGGCCATT CCCA (SEQ ID NO: 156) |
| Paenibacillus NN062253 | 127 | 128 | F-C4AKA TCACCATCATCCTAGGGCGG ACGAGTTCGACACGCTGCGTG (SEQ ID NO: 157) | R-C4AKA TTATTGATTAACGCGTCTA ATTCGCACTCGTCAGACG CAGA (SEQ ID NO: 158) |
| Microbacterium NN062175 | 131 | 132 | F-C3BXT TCACCATCATCCTAGGGCGA CGATCACACAGGTCGCGGTGA (SEQ ID NO: 159) | R-C3BXT TTATTGATTAACGCGTCTA CTGAACGACCACCCCCGT CGTG (SEQ ID NO: 160) |
| Paenibacillus NN062193 | 135 | 136 | F-C597E TCACCATCATCCTAGGGCCG TTCCGCCGCTGCCT (SEQ ID NO: 161) | R-C597E TTATTGATTAACGCGTTTA GAAGGGAGTCACGCTAAT (SEQ ID NO: 162) |
| Paenibacillus NN062193 | 139 | 140 | F-C597F TCACCATCATCCTAGGGCCG TTCCGCCGCTGCCT (SEQ ID NO: 163) | R-C597F TTATTGATTAACGCGTTTA ATTCTCCAGCAGCAGCGC (SEQ ID NO: 164) |

Example 22

Cloning and Expression of a GH9 Gene from *Microbacterium testaceum*

A gene encoding a GH9 was found in the public database (DNA ref EMBL:AP012052; SWISSPROT:E8N9Z4; SEQ ID NO:101 and SEQ ID NO 102 respectively). A synthetic gene was amplified using specific oligos (table 29) and cloned and expressed in *Bacillus subtilis* with N-terminal poly histidine tag (HHHHHHPR-) after the secretion signal as described in examples 2 and 4. The nucleotide sequence of the fusion product corresponds to SEQ ID NO: 103. The translated protein sequence corresponds to SEQ ID NO: 104)

TABLE 29

Primers used for PCR amplification

| EQ ID NO of recombinant gene | SEQ ID NO of poly-peptide | Specific primer forward | Specific primer reverse |
|---|---|---|---|
| 103 | 104 | F-C3FCE TCACCATCATC CTAGGGCAAC AGTCAAACAA GTAGCAGTGT (SEQ ID NO: 165) | R-C3FCE TTATTGATTAA CGCGTTTATTG GACCAAAATG CCCGTCGTT (SEQ ID NO: 166) |

Example 23

Cloning and Expression of 2 GH9 Enzymes from *Paenibacillus* sp-18054 and *Paenibacillus* sp-62408 in *Bacillus subtilis*

A linear integration vector-system was used for the expression cloning of the GH9 from *Paenibacillus* sp-18054 (SEQ ID NO: 85) and the GH9 from *Paenibacillus* sp-62408 (SEQ ID NO: 89). The linear integration construct was a PCR fusion product made by fusion of the gene between two *Bacillus subtilis* homologous chromosomal regions along with a strong promoter and a chloramphenicol resistance marker. The fusion was made by SOE PCR (Horton, R. M., Hunt, H. D., Ho, S. N., Pullen, J. K. and Pease, L. R. (1989), "Engineering hybrid genes without the use of restriction enzymes, gene splicing by overlap extension", *Gene* 77: 61-68). The SOE PCR method is also described in patent application WO 2003095658. The gene was expressed under the control of a triple promoter system (as described in WO 99/43835), consisting of the promoters from *Bacillus licheniformis* alpha-amylase gene (amyL), *Bacillus amyloliquefaciens* alpha-amylase gene (amyQ), and the *Bacillus thuringiensis* cryIIIA promoter including stabilizing sequence. The gene coding for chloramphenicol acetyltransferase was used as marker (described in e.g. Diderichsen, B.; Poulsen, G. B.; Joergensen, S. T., (1993), "A useful cloning vector for *Bacillus subtilis*", *Plasmid*, 30:312). The final gene constructs were integrated on the *Bacillus* chromosome by homologous recombination into the pectate lyase locus. The gene encoding the GH9 from *Paenibacillus* sp-18054 was expressed as a truncated version (SEQ ID NO 87). The GH9 from *Paenibacillus* sp-62408 was expressed as a full length gene (SEQ ID NO 91). The gene fragments were amplified from chromosomal DNA of the corresponding strains with gene specific primers containing overhang to the two flanking vector fragments (primer sequences are listed in table 30). Both genes were expressed with a *Bacillus clausii* secretion signal (with the following amino acid sequence: MKKPLGKIVASTALLISVAFSSSIASA) replacing the native secretion signal and both genes were expressed with a poly histidine-tag (HHHHHH) linked to the C-terminal of the protein. A plasmid map of the linear vector with gene insert is shown in FIG. 1.

TABLE 30

Primers used for PCR amplification

| Amplification of GH9 gene | SEQ ID NO of recombinant gene | SEQ ID NO of poly-peptide | Specific primer forward | Specific primer reverse |
|---|---|---|---|---|
| *Paenibacillus* sp-18054 | 87 | 88 | D14KMG GTTCATCGATCGCATCGGC TGCTCCGGCTCCGCTGC (SEQ ID NO: 167) | D14KMH TTAGTGGTGATGGTGATGATGGTC GTCGAAGAACAGTGTTTGGGC (SEQ ID NO: 168) |
| *Paenibacillus* sp-62408 | 91 | 92 | D14N38 GTTCATCGATCGCATCGGC TGCCACTCCCCCCTTGCC (SEQ ID NO: 169) | D14N39 TTAGTGGTGATGGTGATGATGGTC GGTTACCACTACGTCGTCAAAGA (SEQ ID NO: 170) |

The 2 vector fragments and the gene fragment were subjected to a Splicing by Overlap Extension (SOE) PCR reaction to assemble the 3 fragments into one linear vector construct. This was done independently for each of the two genes. An aliquot of each of the two PCR products was transformed into *Bacillus subtilis*. Transformants were selected on LB plates supplemented with 6 µg of chloramphenicol per ml. For each construct a recombinant *Bacillus subtilis* clone containing the integrated expression construct was grown in liquid culture. The enzyme containing supernatants were harvested and the enzymes purified as described in Example 5.

Example 24

Xanthan Degrading Activity of GH9 Enzymes and Xanthan Lyases by Measurement of Viscosity Reduction Viscosity measurements were carried out using different combinations of xanthan lyases and GH9 endoglucanases as described in example 10. The concentration of the purified enzyme preparations used for the analysis was 31.25 mg/L. Results presented are the average of three measurements.

TABLE 31

Viscosity measurements of different GH9's (SEQ ID NO: 6, 84, 88, 92, 136, 140) and Xanthan Lyases (SEQ ID NO: 8, 108, 112, 116) on xantham gum

| Sample | T = 0 min Average (Pa) | S.D | T = 30 min Average (Pa) | S.D | T = 90 min Average (Pa) | S.D | T = 2 h 30 min Average (Pa) | S.D | T = 3 h 30 min Average (Pa) | S.D |
|---|---|---|---|---|---|---|---|---|---|---|
| Water | 423 | 15 | 406 | 70 | 354 | 85 | 387 | 44 | 418 | 66 |
| Xanthan gum 0.25% (control) | 1140 | 69 | 1099 | 32 | 1011 | 98 | 1020 | 51 | 951 | 40 |
| Xanthan gum + xanthan lyase (SEQ ID NO: 8) + GH9 (SEQ ID NO: 6) | 857 | 67 | 463 | 30 | 441 | 87 | 510 | 21 | 358 | 30 |
| Xanthan gum + xanthan lyase (SEQ ID NO: 8) + GH9 (SEQ ID NO: 84) | 960 | 36 | 533 | 131 | 368 | 31 | 490 | 25 | 455 | 115 |
| Xanthan gum + xanthan lyase (SEQ ID NO: 8) + GH9 (SEQ ID NO: 88) | 1040 | 40 | 496 | 6 | 411 | 35 | 487 | 26 | 401 | 45 |
| Xanthan gum + xanthan lyase (SEQ ID NO: 8) + GH9 (SEQ ID NO: 92) | 1013 | 71 | 659 | 25 | 458 | 46 | 490 | 23 | 361 | 38 |
| Xanthan gum + xanthan lyase (SEQ ID NO: 108) + GH9 (SEQ ID NO: 6) | 1060 | 20 | 549 | 12 | 451 | 44 | 434 | 25 | 408 | 36 |
| Xanthan gum + xanthan lyase (SEQ ID NO: 112) + GH9 (SEQ ID NO: 6) | 1150 | 30 | 689 | 57 | 541 | 30 | 497 | 26 | 478 | 26 |
| Xanthan gum + xanthan lyase (SEQ ID NO: 116) + GH9 (SEQ ID NO: 6) | 1073 | 59 | 583 | 96 | 468 | 59 | 484 | 31 | 391 | 51 |
| Xanthan gum + xanthan lyase (SEQ ID NO: 8) + GH9 (SEQ ID NO: 136) | 930 | 0 | 609 | 133 | 401 | 46 | 444 | 55 | 405 | 15 |
| Xanthan gum + xanthan lyase (SEQ ID NO: 8) + GH9 (SEQ ID NO: 140) | 1083 | 61 | 739 | 32 | 524 | 117 | 484 | 6 | 401 | 55 |

TABLE 32

Viscosity measurements of a GH9 (SEQ ID NO: 88) and a Xanthan Lyase (SEQ ID NO: 120) on xantham gum

| Sample | T = 0 Average (Pa) | S.D | T = 30 min Average (Pa) | S.D | T = 1 hour Average (Pa) | S.D | T = 2 hours Average (Pa) | S.D | T = 3 hours Average (Pa) | S.D |
|---|---|---|---|---|---|---|---|---|---|---|
| Water | 496 | 60 | 606 | 32 | 457 | 29 | 459 | 123 | 423 | 67 |
| Xanthan gum 0.25% (control) | 1092 | 101 | 1112 | 76 | 1137 | 76 | 1089 | 32 | 1123 | 29 |
| Xanthan gum + xanthan lyase (SEQ ID NO: 120) + GH9 (SEQ ID NO: 88) | 946 | 61 | 626 | 45 | 587 | 45 | 486 | 17 | 430 | 40 |

TABLE 33

Viscosity measurements of different GH9s (SEQ ID NO: 96, 100) and a Xanthan Lyase (SEQ ID NO: 68) on xantham gum

| Sample | T = 0 Average (Pa) | S.D | T = 1 hour Average (Pa) | S.D | T = 2 hours Average (Pa) | S.D | T = 3 hours Average (Pa) | S.D | T = 4 hours Average (Pa) | S.D |
|---|---|---|---|---|---|---|---|---|---|---|
| Water | 471 | 133 | 422 | 51 | 411 | 68 | 431 | 134 | 422 | 32 |
| Xanthan gum 0.5% (control) | 2048 | 151 | 2029 | 123 | 2098 | 121 | 2111 | 64 | 2076 | 55 |
| Xanthan gum + xanthan lyase (SEQ ID NO: 68) + GH9 (SEQ ID NO: 96) | 1891 | 65 | 1465 | 76 | 1138 | 58 | 1078 | 59 | 989 | 52 |
| Xanthan gum + xanthan lyase (SEQ ID NO: 68) + GH9 (SEQ ID NO: 100) | 1685 | 81 | 602 | 29 | 538 | 25 | 548 | 45 | 579 | 104 |

TABLE 34

Viscosity measurements of a GH9 (SEQ ID NO: 88) and two Xanthan Lyases (SEQ ID NO: 124, 128) on xantham gum

| Sample | T = 0 Average (Pa) | S.D | T = 30 min Average (Pa) | S.D | T = 1 hour Average (Pa) | S.D | T = 2 hours Average (Pa) | S.D | T = 4 hours Average (Pa) | S.D |
|---|---|---|---|---|---|---|---|---|---|---|
| Water | 408 | 127 | 465 | 105 | 484 | 25 | 423 | 21 | 365 | 32 |
| Xanthan gum 0.5% (control) | 1848 | 86 | 1788 | 25 | 1780 | 78 | 1726 | 26 | 1825 | 55 |
| Xanthan gum + xanthan lyase (SEQ ID NO: 124) + GH9 (SEQ ID NO: 88) | 2105 | 104 | 1691 | 21 | 1364 | 25 | 1246 | 135 | 779 | 17 |
| Xanthan gum + xanthan lyase (SEQ ID NO: 128) + GH9 (SEQ ID NO: 88) | 1515 | 191 | 678 | 70 | 520 | 6 | 469 | 76 | 572 | 32 |

TABLE 35

Viscosity measurements of different GH9's (SEQ ID NO: 6, 58, 104, 132) and Xanthan Lyases (SEQ ID NO: 8, 66, 124, 128) on xantham gum

| Sample | T = 0 Average (Pa) | S.D | T = 30 min Average (Pa) | S.D | T = 1 hour Average (Pa) | S.D | T = 2 hours Average (Pa) | S.D | T = 3 hours Average (Pa) | S.D |
|---|---|---|---|---|---|---|---|---|---|---|
| Water | 444 | 40 | 474 | 125 | 377 | 56 | 520 | 52 | 423 | 75 |
| Xanthan gum 0.25% | 1374 | 31 | 1214 | 57 | 1217 | 62 | 1233 | 40 | 1280 | 25 |
| Xanthan gum + xanthan lyase (SEQ ID NO: 124) + GH9 (SEQ ID NO: 6) | 1231 | 78 | 871 | 75 | 687 | 0 | 720 | 26 | 720 | 93 |
| Xanthan gum + xanthan lyase (SEQ ID NO: 128) + GH9 (SEQ ID NO: 6) | 1124 | 75 | 721 | 92 | 633 | 118 | 693 | 146 | 563 | 26 |
| Xanthan gum + xanthan lyase (SEQ ID NO: 124) + GH9 (SEQ ID NO: 58) | 1128 | 12 | 698 | 92 | 547 | 36 | 640 | 66 | 550 | 91 |
| Xanthan gum + xanthan lyase (SEQ ID NO: 128) + GH9 (SEQ ID NO: 58) | 1088 | 81 | 758 | 17 | 553 | 35 | 340 | 52 | 596 | 49 |

TABLE 35-continued

Viscosity measurements of different GH9's (SEQ ID NO: 6, 58, 104, 132) and Xanthan Lyases (SEQ ID NO: 8, 66, 124, 128) on xantham gum

| Sample | T = 0 Average (Pa) | S.D | T = 30 min Average (Pa) | S.D | T = 1 hour Average (Pa) | S.D | T = 2 hours Average (Pa) | S.D | T = 3 hours Average (Pa) | S.D |
|---|---|---|---|---|---|---|---|---|---|---|
| Xanthan gum + xanthan lyase (SEQ ID NO: 8) + GH9 (SEQ ID NO: 104) | 1184 | 57 | 921 | 67 | 877 | 79 | 683 | 45 | 713 | 40 |
| Xanthan gum + xanthan lyase (SEQ ID NO: 8) + GH9 (SEQ ID NO: 132) | 1211 | 61 | 784 | 64 | 623 | 32 | 767 | 6 | 580 | 12 |
| Xanthan gum + xanthan lyase (SEQ ID NO: 66) + GH9 (SEQ ID NO: 104) | 1278 | 120 | 924 | 21 | 917 | 10 | 770 | 72 | 733 | 106 |
| Xanthan gum + xanthan lyase (SEQ ID NO: 66) + GH9 (SEQ ID NO: 132) | 1238 | 40 | 818 | 46 | 623 | 12 | 807 | 172 | 613 | 82 |

TABLE 36

Viscosity measurements of different GH9's (SEQ ID NO: 136, 140) and a Xanthan Lyase (SEQ ID NO: 68) on xantham gum

| Sample | T = 0 Average (Pa) | S.D | T = 1 hour Average (Pa) | S.D | T = 2 hours Average (Pa) | S.D | T = 3 hours Average (Pa) | S.D | T = 4 hours Average (Pa) | S.D |
|---|---|---|---|---|---|---|---|---|---|---|
| Water | 471 | 133 | 422 | 51 | 411 | 68 | 431 | 134 | 422 | 32 |
| xanthan gum 0.5% (control) | 2048 | 151 | 2029 | 123 | 2098 | 121 | 2111 | 64 | 2076 | 55 |
| Xanthan gum + xanthan lyase (SEQ ID NO: 68) + GH9 (SEQ ID NO: 136) | 1955 | 40 | 1242 | 29 | 911 | 35 | 771 | 32 | 609 | 70 |
| Xanthan gum + xanthan lyase (SEQ ID NO: 68) + GH9 (SEQ ID NO: 140) | 1761 | 61 | 1375 | 50 | 931 | 29 | 775 | 10 | 699 | 36 |

TABLE 37

Viscosity measurements of different GH9's (SEQ ID NO: 96, 100) and different Xanthan Lyases (SEQ ID NO: 8, 66) on xantham gum

| Sample | T = 0 Average (Pa) | S.D | T = 30 min Average (Pa) | S.D | T = 1 hour Average (Pa) | S.D | T = 2 hours Average (Pa) | S.D | T = 4 hours Average (Pa) | S.D |
|---|---|---|---|---|---|---|---|---|---|---|
| Water | 420 | 55 | 415 | 15 | 490 | 62 | 384 | 20 | 409 | 55 |
| Xanthan gum 0.25% | 1320 | 125 | 1230 | 93 | 1195 | 46 | 1204 | 26 | 1174 | 42 |
| Xanthan gum + xanthan lyase (SEQ ID NO: 8) + GH9 (SEQ ID NO: 96) | 1184 | 56 | 695 | 110 | 575 | 107 | 739 | 138 | 549 | 6 |
| Xanthan gum + xanthan lyase (SEQ ID NO: 8) + GH9 (SEQ ID NO: 100) | 1240 | 65 | 615 | 56 | 570 | 70 | 669 | 104 | 599 | 75 |
| Xanthan gum + xanthan lyase (SEQ ID NO: 66) + GH9 (SEQ ID NO: 96) | 1244 | 111 | 610 | 178 | 680 | 82 | 704 | 131 | 654 | 20 |

TABLE 37-continued

Viscosity measurements of different GH9's (SEQ ID NO: 96, 100) and different Xanthan Lyases (SEQ ID NO: 8, 66) on xantham gum

| Sample | T = 0 | | T = 30 min | | T = 1 hour | | T = 2 hours | | T = 4 hours | |
|---|---|---|---|---|---|---|---|---|---|---|
| | Average (Pa) | S.D | Average (Pa) | S.D | Average (Pa) | S.D | Average (Pa) | S.D | Average (Pa) | S.D |
| Xanthan gum + xanthan lyase (SEQ ID NO: 66) + GH9 (SEQ ID NO: 100) | 1249 | 35 | 560 | 165 | 765 | 81 | 534 | 46 | 739 | 144 |

The results presented above show that all of the combinations of the different GH9's and xanthan lyases tested can degrade the xanthan present in the media, thus leading to viscosity reduction.

Example 25

Colourmetric Assay of GH9 Endoglucanases on Pretreated Xanthan Gum

GH9 endoglucanase activity was determined by reducing ends on xanthan gum pre-treated with xanthan lyase using the colorimetric assay developed by Lever (1972), *Anal. Biochem.* 47: 273-279, 1972. Any reducing ends that are produced will react with PAHBAH generating an increase of colour which is proportional to the enzyme activity under the conditions used in the assay. Table 38 below shows the activity of GH9 measured by the respective absorbance compared to that of the substrate alone.

Materials and Chemicals 0.1% Substrate: 6 ml (5 mg/ml) xanthan gum pre-treated with xanthan lyase in 24 ml Milli-Q water.

Activity buffer: 100 mM sodium acetate, 100 mM MES, 1 mM CaCl2, in 0.01% Triton X100, pH 7.

Ka—Na-tartrate/NaOH buffer: Dissolve Ka—Na-tartrate (50 g) and NaOH (20 g) in water to a total volume of 1 liter. Store at 4° C.

Stop solution: Dissolve PAHBAH (Sigma H-9882) in Ka—Na-tartrate/NaOH solution to a concentration of 15 mg/ml (e.g. dissolve 500 mg PAHBAH in 33 ml Ka—Na-tartrate/NaOH solution)

Sample Preparation:

The enzyme samples were diluted to 0.1 mg/ml in activity buffer in costarstrips using a BioMek liquid handler robot. 50 μl of substrate and 50 μl of each diluted sample was transferred to a 96-well PCR-MTP plate, 50 μl activity buffer was added to each sample and the solutions mixed. The sealed PCR-plate was incubated in a PCR machine at 37° C. for 15 min. then immediately cooled to 10° C. 75 μl of the stop solution was added to each sample, the mixture was shaken, and 75 μl of each sample was discarded. The samples were incubated for 10 min. at 95° C., then 1 min. 10° C. 150 μl of each sample was transferred to a new 96-well PCR-MTP and the absorbance at 405 nm was measured.

TABLE 38

Colourmetric reducinq ends assay of different GH9s on xanthan gum pre-treated with xanthan lyase

| GH9 endoglucanase | mAU (pH 7) |
|---|---|
| Blank | 0.21 |
| SEQ ID NO: 6 | 1.25 |

TABLE 38-continued

Colourmetric reducinq ends assay of different GH9s on xanthan gum pre-treated with xanthan lyase

| GH9 endoglucanase | mAU (pH 7) |
|---|---|
| SEQ ID NO: 58 | 1.26 |
| SEQ ID NO: 92 | 1.09 |
| SEQ ID NO: 100 | 1.18 |

The data shows that the reaction of xanthan gum pre-treated with xanthan lyase with a GH9 endoglucanase results in a stronger colourmetric response. Since the colourmetric response is proportional to the amount of reducing ends produced, then it can clearly be seen that the GH9 endoglucanases have activity on xanthan gum pre-treated with xanthan lyase.

Example 26

Colourmetric Assay of Xanthan Lyases on Xanthan Gum

Xanthan lyase activity was determined by reducing ends as described in example 25, except that 0.1% xanthan gum was used as substrate. The results are presented in table 39 below.

TABLE 39

Colourmetric reducing ends assay of different xanthan lyases on xanthan gum.

| Xanthan Lyase | mAU (pH 7) |
|---|---|
| Blank | 0.21 |
| SEQ ID NO: 8 | 0.65 |
| SEQ ID NO: 120 | 0.46 |
| SEQ ID NO: 68 | 0.63 |
| SEQ ID NO: 116 | 0.65 |
| SEQ ID NO: 112 | 0.66 |
| SEQ ID NO: 108 | 0.48 |
| SEQ ID NO: 66 | 0.44 |

The data shows that the reaction of xanthan gum with a xanthan lyase results in a stronger colourmetric response and therefore the xanthan lyases have activity on xanthan gum.

Example 27

Colourmetric Assay of Xanthan Lyases and GH9 Engoglucanases on Xanthan Gum

Xanthan lyase activity alone and together with a GH9 endoglucanase was determined by reducing ends as described in example 25, except that 0.1% xanthan gum was used as substrate. The results are presented in tables 40 and 41 below.

TABLE 40

Colourmetric reducina ends assay of different xanthan lyases alone or incombination with a GH9 endoqlucanase on xanthan gum

| Xanthan Lyase | mAU (pH 7) of xanthan lyase alone | mAU (pH 7) of xanthan lyase + GH9 endoglucanase (SEQ ID NO: 6) |
|---|---|---|
| Blank | 0.14 | 0.15 |
| Xanthan lyase (SEQ ID NO: 8) | 0.61 | 2.06 |
| Xanthan lyase (SEQ ID NO: 112) | 0.51 | 1.91 |
| Xanthan lyase (SEQ ID NO: 124) | 0.42 | 1.91 |
| Xanthan lyase (SEQ ID NO: 128) | 0.43 | 1.85 |

TABLE 40

Relative response of colourmetric reducing ends assay of different xanthan lyases alone or incombination with a GH9 endoglucanase on xanthan gum

| Xanthan Lyase | Relative response of xanthan lyase alone | Relative response of xanthan lyase + GH9 endoglucanase (SEQ ID NO: 6) |
|---|---|---|
| Blank | 23 | 25 |
| Xanthan lyase (SEQ ID NO: 8) | 100 | 337 |
| Xanthan lyase (SEQ ID NO: 112) | 84 | 312 |
| Xanthan lyase (SEQ ID NO: 124) | 69 | 312 |
| Xanthan lyase (SEQ ID NO: 128) | 71 | 302 |

Responses are set relative to the response of xanthan lyase of SEQ ID NO: 8 which is set to 100.

The data shows that the reaction of xanthan gum with a xanthan lyase results in a significantly stronger colourmetric response and therefore the xanthan lyases alone have significant activity on xanthan gum. Furthermore, addition of the GH9 endoglucanase of SEQ ID NO: 6 results in at least a 3-4 fold increase in colourmetric response over the use of the xanthan lyase alone, showing that use of the two enzymes together results in a synergistic degradation of xanthan gum.

Example 28

MiniLOM Wash Performance of Xanthan Lyase (SEQ ID NO:) and/or GH9 (SEQ ID NO:)

The enzymes of the present invention were tested using the miniLOM assay in order to determine the "enzyme detergency effect". Test tubes are filled with test solution, soiled fabrics and steel balls and rotated in a heating cabinet at a given temperature. Cleaning benefits are studied when washing in model liquid detergent A. The experimental conditions for the experiments are specified in Table 41.

TABLE 41

Experimental conditions for MiniLOM

| | |
|---|---|
| Test solution | Model detergent A |
| Test solution volume | 40 mL |
| pH | Not adjusted |
| Wash time | 30 minutes |
| Temperature | 40° C. |
| Water hardness | 16° dH |
| Enzyme dosage | Xanthan lyase: 1 mg EP/L |
| | GH9: 0.5 mg EP/L |
| $Ca^{2+}:Mg^{2+}:CO_3^{2-}$ ratio | 5:1:3 |
| Swatches | Circular swatches 2 cm in diameter |
| Stains | 4 × DN31C (Half amount of xanthan gum/carbon black); |
| | 4 × DN31D (Xanthan gum/carbon black) |
| Ballast | 4 × wfk10A (100% woven cotton) |
| | 4 × wfk80A (100% knitted cotton) |
| Mechanics | 5 stainless steel balls, 6 mm in diameter |

Water hardness was adjusted by addition of $CaCl_2$, $MgCl_2$, and $NaHCO_3$ to the test system. After washing the textiles were flushed in tap water and air-dried. The swatches were prepared by adding xanthan gum from *Xanthomonas campestris* (Food Grade Keltrol T, Kelco) mixed with carbon black to a cotton fabric. The DN31C swatch is prepared with half the amount of xanthan gum; otherwise it is identical to the DN31D swatch. However, this does have the effect of reducing the measurement window for enzymatic effects, in that the amount of xanthan gum which may be removed is reduced. In effect, this leads to a smaller increase in intensity when compared to the detergent alone effects, but should not be construed as a lesser enzymatic effect.

The performance of the enzyme(s) is evaluated by measuring the remission of the textile swatches using the ColorEye at 460 nm. The results using swatch C are presented in tables 42 and 43, whilst the results using swatch D are presented in tables 44 and 45.

Remission Measured Before Wash:

Swatch DN31C: 28.87±0.37

Swatch DN31D: 29.34±0.66

Remission Measured Using Detergent Only:

Swatch DN31C: 35.37±1.00

Swatch DN31D: 39.79±1.28

TABLE 42

Remission (460 nm) values of MimiLOM wash using 6 different GH9 endoglucanases and 6 different xanthan lyases on swatch DN31C

| | Xanthan Lyase | | | | | |
|---|---|---|---|---|---|---|
| $Rem_{460}$ GH9 endoglucanase | SEQ ID NO: 8 | SEQ ID NO: 66 | SEQ ID NO: 108 | SEQ ID NO: 112 | SEQ ID NO: 116 | SEQ ID NO: 120 |
| SEQ ID NO: 6 | 42.17 | 43.07 | 41.70 | 43.00 | 42.05 | 42.39 |
| SEQ ID NO: 84 | 37.06 | 39.06 | 38.19 | 38.48 | 37.56 | — |
| SEQ ID NO: 88 | 37.29 | 39.46 | 38.18 | 38.80 | 39.62 | 37.00 |
| SEQ ID NO: 92 | 38.90 | 40.21 | 39.27 | 40.01 | 38.89 | — |
| SEQ ID NO: 96 | 37.00 | 38.68 | 36.92 | 37.32 | — | — |
| SEQ ID NO: 100 | 36.33 | 38.45 | 37.63 | 37.60 | 36.39 | 36.91 |

TABLE 43

Standard Deviation of MimiLOM results on swatch DN31C

| Standard deviation GH9 endoglucanase | Xanthan Lyase | | | | | |
|---|---|---|---|---|---|---|
| | SEQ ID NO: 8 | SEQ ID NO: 66 | SEQ ID NO: 108 | SEQ ID NO: 112 | SEQ ID NO: 116 | SEQ ID NO: 120 |
| SEQ ID NO: 6 | 0.80 | 0.49 | 0.64 | 0.30 | 0.43 | 0.61 |
| SEQ ID NO: 84 | 0.79 | 0.55 | 0.98 | 0.91 | 1.06 | — |
| SEQ ID NO: 88 | 0.73 | 0.53 | 0.91 | 0.49 | 0.30 | 0.62 |
| SEQ ID NO: 92 | 0.85 | 0.50 | 0.84 | 0.72 | 0.61 | — |
| SEQ ID NO: 96 | 1.20 | 1.48 | 0.69 | 0.96 | — | — |
| SEQ ID NO: 100 | 0.70 | 0.51 | 0.83 | 0.90 | 0.70 | 0.74 |

The results show that the GH9 endoglucanases of SEQ ID NO: 6, 84, 88 and 92 give a statistically significant wash performance according to the ANOVA tukey test on swatch DN31C together with the xanthan lyases of SEQ ID NO: 8, 66, 108, 112, 116 and 120 in all cases. Furthermore, the GH9 endoglucanases of SEQ ID NO: 100 showed a statistically significant wash performance with the xanthan lyases of SEQ ID NO: 66, 108, 112 and 120 and at least a numerically improved wash performance with the xanthan lyases of SEQ ID NO: 8 and 116.

TABLE 44

Remission (460 nm) values of MimiLOM wash using 6 different GH9 endoglucanases and 6 different xanthan lyases on swatch DN31D

| Rem$_{460}$ GH9 endoglucanase | Xanthan Lyase | | | | | |
|---|---|---|---|---|---|---|
| | SEQ ID NO: 8 | SEQ ID NO: 66 | SEQ ID NO: 108 | SEQ ID NO: 112 | SEQ ID NO: 116 | SEQ ID NO: 120 |
| SEQ ID NO: 6 | 48.79 | 49.36 | 47.72 | 49.02 | 48.28 | 48.78 |
| SEQ ID NO: 84 | 41.98 | 42.66 | 43.01 | 43.16 | 42.24 | — |
| SEQ ID NO: 88 | 41.72 | 43.67 | 42.56 | 42.94 | 43.25 | 42.65 |
| SEQ ID NO: 92 | 43.59 | 44.15 | 44.20 | 44.88 | 43.84 | — |
| SEQ ID NO: 96 | 40.98 | 41.25 | 41.49 | 41.17 | — | — |
| SEQ ID NO: 100 | 40.88 | 42.13 | 41.83 | 42.28 | 41.46 | 41.43 |

TABLE 45

Standard Deviation of MimiLOM results on swatch DN31D

| Standard deviation GH9 endoglucanase | Xanthan Lyase | | | | | |
|---|---|---|---|---|---|---|
| | SEQ ID NO: 8 | SEQ ID NO: 66 | SEQ ID NO: 108 | SEQ ID NO: 112 | SEQ ID NO: 116 | SEQ ID NO: 120 |
| SEQ ID NO: 6 | 1.14 | 0.66 | 0.60 | 0.44 | 0.29 | 0.41 |
| SEQ ID NO: 84 | 1.18 | 0.68 | 1.55 | 1.65 | 1.79 | — |
| SEQ ID NO: 88 | 1.28 | 0.49 | 1.93 | 1.85 | 0.33 | 1.75 |
| SEQ ID NO: 92 | 1.66 | 0.30 | 1.23 | 1.50 | 1.13 | — |
| SEQ ID NO: 96 | 1.45 | 1.26 | 1.02 | 1.67 | — | — |
| SEQ ID NO: 100 | 1.08 | 0.74 | 1.46 | 1.42 | 1.47 | 0.73 |

The results show that the GH9 endoglucanases of SEQ ID NO: 6, 84 and 92 showed a statistically significant wash performance according to the ANOVA tukey test on swatch DN31D together with the xanthan lyases of SEQ ID NO: 8, 66, 108, 112, 116 and 120 in all cases. Furthermore, the GH9 endoglucanase of SEQ ID NO: 88 showed a statistically significant wash performance with the xanthan lyases of SEQ ID NO: 66, 108, 112, 116 and 120 and a numerically improved wash performance with the xanthan lyase of SEQ ID NO: 8. The GH9 endoglucanase of SEQ ID NO: 100 showed a statistically significant wash performance with the xanthan lyases of SEQ ID NO: 66, 108 and 112 and a numerically improved wash performance with the other 3 xanthan lyases. The GH9 endoglucanases of SEQ ID NO: 96 showed a numerically improved wash performance together with all of the xanthan lyases tested.

Example 29

Xanthan Degrading Activity of GH9 Endoglucanases and Xanthan Lyases by Measurement of Viscosity Reduction Viscosity measurements were carried as described in example 10 on two different batches of the GH9 endoglucanase of SEQ ID NO: 6 and a single batch of the GH9 endoglucanase of SEQ ID NO: 2 together with two different xanthan lyases (SEQ ID NO: 8 and 66). SEQ ID NO: 6 is identical to SEQ ID NO: 2 except that it contains a His-tag (i.e. -RPHHHHHH) attached to the N-terminal of the mature polypeptide. The concentration of the purified enzyme preparations used for the analysis was 31.25 mg/L. Results presented are the average of three measurements and are shown in table 46 below.

TABLE 46

Viscosity measurements of the same GH9 with and without His-tag (SEQ ID NO: 2, 6) and two different xanthan lyases (SEQ ID NO: 8, 66) on xantham gum

| Sample | T = 0 Average (Pa) | S.D | T = 30 min Average (Pa) | S.D | T = 1 hour Average (Pa) | S.D | T = 2 hours Average (Pa) | S.D | T = 4 hours Average (Pa) | S.D |
|---|---|---|---|---|---|---|---|---|---|---|
| Water | 400 | 10 | 441 | 44 | 420 | 21 | 410 | 0 | 518 | 124 |
| Xanthan gum 0.5% (control) | 1106 | 81 | 1144 | 50 | 1196 | 55 | 1123 | 58 | 1075 | 40 |
| Xanthan gum + xanthan lyase (SEQ ID NO: 8) + GH9 (SEQ ID NO: 6)* | 890 | 26 | 624 | 85 | 543 | 56 | 567 | 38 | 561 | 35 |
| Xanthan gum + xanthan lyase (SEQ ID NO: 8) + GH9 (SEQ ID NO: 2) | 986 | 55 | 577 | 40 | 586 | 75 | 523 | 23 | 525 | 46 |
| Xanthan gum + xanthan lyase (SEQ ID NO: 8) + GH9 (SEQ ID NO: 6)** | 1030 | 72 | 644 | 75 | 626 | 175 | 547 | 21 | 565 | 72 |
| Xanthan gum + xanthan lyase (SEQ ID NO: 66) + GH9 (SEQ ID NO: 6)* | 986 | 108 | 604 | 80 | 563 | 62 | 650 | 72 | 525 | 61 |
| Xanthan gum + xanthan lyase (SEQ ID NO: 66) + GH9 (SEQ ID NO: 2) | 1093 | 95 | 611 | 75 | 606 | 98 | 593 | 50 | 601 | 21 |
| Xanthan gum + xanthan lyase (SEQ ID NO: 66) + GH9 (SEQ ID NO: 6)** | 1080 | 56 | 557 | 31 | 580 | 40 | 597 | 90 | 628 | 108 |

*batch 1;
**batch 2

The results in table 46 show that there is no significant difference in the drop in viscosity between the two batches of the GH9 endoglucanase of SEQ ID NO: 6 which has a His-tag and the GH9 endoglucanase of SEQ ID NO: 2 which is without the His-tag together with either xanthan lyase. It can therefore be concluded that the His-tag does not alter the xanthan gum degrading properties of the GH9 endoglucanase of SEQ ID NO: 2.

Example 30

Colourmetric Assay of GH9 Endoglucanases and Xanthan Lyases on Xanthan Gum

The activity of GH9 endoglucanases alone and in combination with different xanthan lyases on xanthan gum was determined by reducing ends as described in example 25, except that 0.1% xanthan gum was used as substrate. The results are presented in table 47 below.

TABLE 47

Colourmetric reducing ends assay of different GH9 endoglucanases (SEQ ID NO: 2, 6, 16, 58, 84, 92, 96 and 100) and xanthan lyases (SEQ ID NO: 8, 66, 68, 120) on xanthan gum.

| mAU (pH 7) Xanthan Lyase | GH9 endoglucanase ||||||||||
|---|---|---|---|---|---|---|---|---|---|---|
| | SEQ ID NO: 6* | SEQ ID NO: 6** | SEQ ID NO: 2 | SEQ ID NO: 16 | SEQ ID NO: 58 | SEQ ID NO: 84 | SEQ ID NO: 88 | SEQ ID NO: 92 | SEQ ID NO: 96 | SEQ ID NO: 100 |
| SEQ ID NO: 8 | 1.75 | 1.53 | 1.62 | 1.54 | 2.28 | 2.22 | 1.70 | 1.84 | 1.45 | 1.86 |
| SEQ ID NO: 66 | 1.78 | 1.58 | 1.84 | 1.69 | 1.88 | 2.16 | 1.86 | 1.77 | 1.46 | 1.96 |
| SEQ ID NO: 68 | 2.08 | 1.92 | 1.87 | 1.93 | 2.22 | 2.10 | 2.02 | 1.79 | 1.53 | 1.88 |
| SEQ ID NO: 120 | 1.04 | 1.05 | 1.08 | 0.91 | 1.62 | 1.73 | 1.40 | 1.35 | 0.95 | 1.42 |
| None | 0.47 | 0.42 | 0.45 | 0.25 | 0.77 | 0.66 | 0.26 | 0.24 | 0.27 | 0.30 |

*batch 1;
**batch 2

The results demonstrate that all of the GH9 endoglucanases together with all of the xanthan lyases tested give a significant increase in colourmetric response showing that the combination of these GH9 endoglucanases and xanthan lyases has significant activity on degrading xanthan gum. The results further show that there is no significant difference between the two batches of the GH9 endoglucanase of SEQ ID NO: 6 tested, nor that the His-tag which is present on the GH9 endoglucanase of SEQ ID NO: 6 results in any significant change in performance over the corresponding GH9 endoglucanase without His-tag (SEQ ID NO: 2).

Example 31

AMSA Wash Performance of Xanthan Lyases and GH9 Endoglucanases

The experiments were conducted as described in the Automatic Mechanical Stress Assay (AMSA) for laundry method using a single cycle wash procedure and the experimental conditions specified in table 48 below. The results are given in tables 49 and 50 using 3 different GH9 endoglucanases and 6 different xanthan lyases along with controls where either the GH9 endoglucanase and/or xanthan lyase are absent. The results are shown as the ΔInt enzyme value.

TABLE 48

Experimental conditions for Wash Cycle

| | |
|---|---|
| Test solution | 3.33 g/L Model liquid detergent B |
| Test solution volume | 140 μL detergent per slot; 20 μL enzyme per slot |
| pH | Unadjusted |
| Wash time | 20 minutes |
| Temperature | 20° C. or 40° C. |
| Enzyme dosage | Xanthan lyase: 1 mg EP/L<br>GH9: 0.5 mg EP/L |
| Water hardness | 15° dH |
| $Ca^{2+}:Mg^{2+}:CO_3^{2-}$ ratio | 5:1:3 |
| Swatch | DN31C (Half amount of xanthan gum with carbon black) |

Water hardness was adjusted by addition of $CaCl_2$, $MgCl_2$, and $NaHCO_3$ to the test system. After washing the textiles were flushed in tap water and air-dried. The swatches were prepared by adding xanthan gum from *Xanthomonas campestris* (Food Grade Keltrol T, Kelco) mixed with carbon black to a cotton fabric. The DN31C swatch is prepared with half the amount of xanthan gum; otherwise it is identical to the DN31D swatch. However, this does have the effect of reducing the measurement window for enzymatic effects, in that the amount of xanthan gum which may be removed is reduced. In effect, this leads to a smaller increase in intensity when compared to the detergent alone effects, but should not be construed as a lesser enzymatic effect.

TABLE 49

AMSA wash data using model liquid detergent B at 20° C. on swatch DN31C

| ΔInt enzyme value. | GH9 endoglucanase | | | |
|---|---|---|---|---|
| Xanthan Lyase | Control | SEQ ID NO: 6 | SEQ ID NO: 88 | SEQ ID NO: 100 |
| Control | 0.0 | 5.9 | 2.9 | 2.0 |
| SEQ ID NO: 8 | 5.0 | 16.3 | 6.4 | 0.9 |
| SEQ ID NO: 66 | 2.5 | 14.4 | 6.6 | 3.5 |
| SEQ ID NO: 108 | −0.2 | 10.8 | — | — |
| SEQ ID NO: 116 | 5.6 | 12.0 | — | — |
| SEQ ID NO: 124 | −0.4 | 8.5 | — | — |
| SEQ ID NO: 128 | 4.6 | 13.1 | — | — |

TABLE 50

AMSA wash data using model liquid detergent B at 40° C. on swatch DN31C

| ΔInt enzyme value. | GH9 endoglucanase | | | |
|---|---|---|---|---|
| Xanthan Lyase | Control | SEQ ID NO: 6 | SEQ ID NO: 88 | SEQ ID NO: 100 |
| Control | 0.0 | 7.3 | 3.3 | 3.7 |
| SEQ ID NO: 8 | 4.8 | 16.1 | 8.0 | 3.0 |
| SEQ ID NO: 66 | 2.2 | 16.2 | 9.3 | 6.1 |
| SEQ ID NO: 108 | −3.7 | 9.7 | — | — |
| SEQ ID NO: 116 | 6.2 | 12.0 | — | — |
| SEQ ID NO: 124 | 1.0 | 10.1 | — | — |
| SEQ ID NO: 128 | 6.8 | 13.3 | — | — |

The data shows that the GH9 endoglucanase of SEQ ID NO: 6 gives a significant wash effect with all of the xanthan lyases (i.e. SEQ ID NO: 8, 66, 108, 116, 124 and 128) tested at both 20° C. and 40° C. Furthermore, the GH9 endoglucanase of SEQ ID NO: 88 give a significant wash effect with both xanthan lyases tested, and a significant synergistic effect together with the xanthan lyase of SEQ ID NO: 66. The GH9 endoglucanase of SEQ ID NO: 100 shows a significant wash effect with the xanthan lyase of SEQ ID NO: 66 at both 20° C. and 40° C.

Example 32

MiniLOM Wash Performance of GH9 Endoglucanase

The GH9 endoglucanases were tested using the miniLOM assay in order to determine the enzyme detergency benefit of the GH9 endoglucanase. The enzyme detergency benefit was studied by comparing the wash effect on xanthan gum with carbon black stains with and without a GH9 endoglucanase in either buffer (2-(N-morpholino)ethanesulfonic acid, MES), or model detergent A using the conditions described in table 51. The results for stain DN31C are given in tables 52 and 53 and for stain DN31D are given in tables 54 and 55.

TABLE 51

MiniLOM Wash Conditions

| | |
|---|---|
| Test solution | Buffer (50 mM MES) or Model Detergent A (3.33 g/L) |
| Test solution volume | 40 mL |
| pH | Adjusted to pH 7.0 (buffer) or pH 7.2 (Model Detergent A) prior to wash |
| Wash time | 30 minutes |
| Temperature | 40° C. |
| Water hardness | 16° dH |
| $Ca^{2+}:Mg^{2+}:CO_3^{2-}$ ratio | 5:1:3 |

TABLE 51-continued

MiniLOM Wash Conditions

| | |
|---|---|
| Swatches | Circular swatches 2 cm in diameter |
| Stains | 8 × Technical stains with Xanthan Gum with Carbon Black. Stain DN31D has 2x xanthan gum compared to DN31C. |
| Ballast | 4 × wfk10A (100% woven cotton) |
| | 4 × wfk80A (100% knitted cotton) |
| Total ballast weight | Technical stains: 0.43 g per tube |
| | Ballast stains: 0.53 g per tube |
| Mechanics | 5 stainless steel balls, 6 mm in diameter |

Water hardness was adjusted by addition of $CaCl_2$, $MgCl_2$, and $NaHCO_3$ to the test system. After washing, the textiles were flushed in tap water and air-dried. The swatches were prepared by applying a mixture of carbon black (0.05-0.06 g) and xanthan gum (1.2-1.4 g for DN31C, 2.4-2.6 g for DN31D, *Xanthomonas campestris* (Food Grade Keltrol T, Kelco) per square meter of cotton fabric. The enzyme detergency benefit of the enzyme(s) was evaluated by measuring the remission of the textile swatches using the ColorEye at 460 nm as described in the Evaluation of Stains.

TABLE 52

Results of GH9 Endoglucanse (SEQ ID NO: 6) on Xanthan Gum/Carbon Black Stains (DN31C)

| GH9 | Buffer (50 mM MES) | | Model Detergent A | |
|---|---|---|---|---|
| (mg/L) | REM (460 nm) | Std. Dev. | REM (460 nm) | Std. Dev. |
| 0 | 34.5 | 0.6 | 36.8 | 2.9 |
| 0.2 | 40.3 | 0.2 | 41.1 | 0.3 |
| 0.4 | 39.6 | 0.3 | 41.1 | 0.7 |
| 0.8 | 40.4 | 0.4 | 41.0 | 0.4 |

TABLE 53

Results of GH9 Endoglucanse (SEQ ID NO: 6) on Xanthan Gum/Carbon Black Stains (DN31C)

| GH9 | Buffer (50 mM MES) | | Model Detergent A | |
|---|---|---|---|---|
| (mg/L) | REM (460 nm) | Std. Dev. | REM (460 nm) | Std. Dev. |
| 0 | 35.4 | 0.5 | 36.7 | 0.3 |
| 0.05 | 39.6 | 0.9 | 39.1 | 2.8 |
| 0.1 | 39.3 | 1.0 | 40.6 | 0.5 |
| 0.2 | 39.8 | 0.4 | 40.9 | 0.3 |
| 0.5 | 40.0 | 0.3 | 40.9 | 0.4 |
| 0.5 ppm BSA[1] | 35.4 | 0.2 | 35.8 | 0.1 |

[1]BSA—Bovine serum albumine added instead of GH9 endoglucanase

TABLE 54

Results of GH9 Endoglucanse (SEQ ID NO: 6) on Xanthan Gum/Carbon Black Stains (DN31D)

| GH9 | Buffer (50 mM MES) | | Model Detergent A | |
|---|---|---|---|---|
| (mg/L) | REM (460 nm) | Std. Dev. | REM (460 nm) | Std. Dev. |
| 0 | 39.8 | 0.7 | 40.9 | 1.7 |
| 0.2 | 47.2 | 0.3 | 47.6 | 0.4 |
| 0.4 | 46.5 | 0.4 | 47.6 | 0.4 |
| 0.8 | 46.8 | 0.4 | 48.0 | 0.6 |

TABLE 55

Results of GH9 Endoglucanse (SEQ ID NO: 6) on Xanthan Gum/Carbon Black Stains (DN31D)

| GH9 | Buffer (50 mM MES) | | Model Detergent A | |
|---|---|---|---|---|
| (mg/L) | REM (460 nm) | Std. Dev. | REM (460 nm) | Std. Dev. |
| 0 | 40.2 | 0.9 | 41.6 | 0.4 |
| 0.05 | 46.2 | 0.8 | 45.3 | 4.1 |
| 0.1 | 45.8 | 0.7 | 47.3 | 0.9 |
| 0.2 | 46.4 | 0.4 | 47.8 | 0.8 |
| 0.5 | 46.6 | 1.0 | 48.0 | 1.1 |
| 0.5 ppm BSA[1] | 39.4 | 0.3 | 41.4 | 0.8 |

[1]BSA—Bovine serum albumine added instead of GH9 endoglucanase

The results showed that there was significant enzyme detergency, stain removal and cleaning benefits when the GH9 endoglucanase (SEQ ID NO: 6) was added to the wash solution using either buffer (50 mM MES) or with model detergent A. Tables 52 and 54 show that the same enzyme detergency benefit was observed when between 0.2 and 0.8 mg enzyme protein per L wash liquor was used, indicating that a plateau level may already have be reached when dosing above 0.2 mg EP/L.

Repeating the experiment using lower amounts of endoglucanase (SEQ ID NO: 6) (tables 53 and 55) showed that significant enzyme detergency benefit was apparent even at 0.05 mg enzyme protein per L wash liquor. The addition of 0.5 ppm bovine serum albumine instead of the GH9 endoglucanase showed that the enzyme detergency benefit was not due to an unspecific protein effect.

The largest effect can be seen on stain DN31D where benefits of up to 7 delta REM units were found when using either buffer (50 mM MES) or with model detergent A.

Example 33

Effects of GH9 Endoglucanase on (Pre-Treated) Xanthan Gum as Determined by Viscosity Reduction 0.5% pre-treated xanthan gum was prepared by pre-treating the xanthan gum with xanthan lyase as described in Nankai, H., Hashimoto, W., Miki, H., Kawai, S., and Murata, K. (1999) "Microbial system for polysaccharide depolymerization: Enzymatic route for xanthan depolymerization by *bacillus* sp strain gl1", *Applied and Environmental Microbiology* 65, 2520-2526. Prior to use all enzymes were buffer changed to the MES buffer using NAP 5 columns (GE Healthcare).

The samples were hydrolysed using the following conditions: 0.25% xanthan gum or 0.5% pre-treated xanthan gum in 50 mM MES buffer+0.01% triton x-100 at pH 7.0 and 40° C.

The initial viscosity was measured upon thermal equilibration and prior to enzyme addition using the ViPr assay. After thermal equilibration, the GH9 endoglucanase (SEQ ID NO: 6) (20 mg/L), if appropriate, was added and the viscosity was then measured at various time points. The data is presented in table 56 below.

TABLE 56

Results of GH9 Endoglucanse (SEQ ID NO: 6) on Xanthan Gum and Pre-treated Xanthan Gum as determined by Viscosity Reduction

| Measurements Conditions | Incubation Time | | | | | | | | | |
|---|---|---|---|---|---|---|---|---|---|---|
| | 0 min | | 5 min | | 15 min | | 30 min | | 3 hous | |
| | Mean Pa | Std Dev ± | Mean Pa | Std Dev ± | Mean Pa | Std Dev ± | Mean Pa | Std Dev ± | Mean Pa | Std Dev ± |
| Buffer (control, no enzyme) | 515 | 15 | 558 | 15 | 524 | 82 | 560 | 68 | 517 | 42 |
| Xanthan gum (control, no enzyme) | 1148 | 32 | 1146 | 32 | 1174 | 10 | 1136 | 12 | 1077 | 45 |
| Xanthan gum + GH 9 (SEQ ID NO: 6) | 1042 | 17 | 903 | 17 | 867 | 6 | 846 | 38 | 837 | 55 |
| Pre-treated Xanthan gum (control, no enzyme) | 1135 | 120 | 1206 | 120 | 1314 | 0 | 1223 | 71 | 1247 | 46 |
| Pre-treated Xanthan gum + GH 9 (SEQ ID NO: 6) | 1025 | 15 | 629 | 15 | 661 | 70 | 553 | 49 | 544 | 30 |

The buffer control represents the viscosity representative of complete hydrolysis. At this point there are little to no solvent-polymer interactions which would lead to an increase in solvent viscosity. The xanthan gum and modified xanthan gum controls remain constant throughout the incubation displaying the robustness of the assay. The GH9 endoglucanase (SEQ ID NO: 6) is seen to decrease the xanthan gum substrate over the course of the 3 h incubation but the viscosity does not reach the viscosity of the control. The xanthan lyase pretreated xanthan gum is reduced to the buffer viscosity almost immediately under these conditions by the GH9 endoglucanase (SEQ ID NO: 6).

Example 34

Effects of GH9 Endoglucanase on (Pre-Treated) Xanthan Gum as Determined by Reducing Ends 0.25% pre-treated xanthan gum was prepared by pre-treating the xanthan gum with xanthan lyase as described in example 33. Prior to use all enzymes were buffer changed to the MES buffer using NAP 5 columns (GE Healthcare). The samples were hydrolysed using the following conditions: 0.25% xanthan gum or 0.25% pre-treated xanthan gum in 50 mM MES buffer+0.01% triton x-100 at pH 7.0 and 30° C.

After thermal equilibration, the GH9 endoglucanase (SEQ ID NO: 6) (62 mg/L), if appropriate, was added and the produced reducing ends were measured at the end point using the BCA Reducing Ends assay. Quantification of reducing ends was based on a glucose standard curve and the results are shown in table 57 below.

TABLE 57

Results of GH9 Endoglucanase (SEQ ID NO: 6) on Xanthan Gum and Pre-treated Xanthan Gum as determined by Reducing Ends

| Incubation Time Measurements Conditions | BCA at 30 min | |
|---|---|---|
| | Average μM glucose equivalents | Standard deviation ± |
| Buffer (control, no enzyme) | 0 | 0 |
| Xanthan gum (control, no enzyme) | 173 | 5 |
| Xanthan gum + GH 9 (SEQ ID NO: 6) | 177 | 5 |
| Pre-treated Xanthan gum (control, no enzyme) | 534 | 21 |
| Pre-treated Xanthan gum + GH 9 (SEQ ID NO: 6) | 2367 | 455 |

SEQUENCE LISTING (170 sequences)

SEQ ID NO: 1 - DNA, 3282 bp, Paenibacillus sp.
  CDS (1)..(3279)
  sig_peptide (1)..(114)
  mat_peptide (115)..(3279)
atggtattcaatcagaatgtccaaatgttttataggcggtgggtatccctattacttgccatgttgatgacggttctggcacccttgactatcatggtcgacaatgcacatgcaatcgcaggcgtggttcaaagcgtgaatgtctcccaagctggttatagttcaaacgattttaagacggctacggtgactgcgtcggataaactaagcgatactagctaccagatattgcaaggcactaccgttatcgcaaccggtacgatgaaggatgaaggatatgtatggggcaaatatgtgtactcgatcgatttctcctccgttacagctacgggcaccaactttacgatccgtagcaacggagtttcatcttacacgttccctatccaaaccaatatgtggaatgaatataaggatgaaatgaccgcgttctaccgtttgctccggactacggatacctttgcggcctatcctgcagggtacagcaatattgcgccttcgaataaaatattacatccggattctttccttgatgatgctttttcgccggaccgaacgacgcattatgacctgactggcggttggttcgatgcaggagactacggtaagtatggcggcaatcagtgggtacagggaaatatcgccatctcttatctgcggcatgcctcttcggcggcggtcaatttcgataaggataccaacggcattccggatctggtggatgaagcgatctttggtagtcagtacttggtgaagtttgccaatcagcttggcggggccattcataatattttgaggaaaggcggctttgtgcttccgcataaagtgacagacaatgttccgggtaacacagacgaccgagcgctcgaagctgtcgaagcggtgggaggctccgggaaatcctctggctcgctggcggcaacggcgcgagcgattcgcactgccatcgcgggcggtaaagtggcagcgaataaagtcgcccagctgcagacacttgcgaatgagtttcaggctgccgcaatcatcttctataattacacattgactcatcaaagtggaaaccatggctcctatggaacaatgaacaatggagggattgcaaatcctctcttatgggcggaagtacagttgtatctgttaacaggggacgctgcatacaagacgcaagctcagacacgcattaatgcaataaatgaagcctatgtttcgtccacgaattattgggatatgcatccgattgcgctggccgaattttatccggtcgcggacagcgcgatcaaaaccaaaattcaaagtatcctgaagcaccaagcatattatttcatcacgctgatggatgaaacgccatacggtgtattgaaccaattcggcaattttggtgtgaatgagccgcatgcatcgtatatggccgatttgctccgatattatgaattgtttaacgatccggtagcgcttcgagcggcgaagaaggcgctgtactggattgtcggcaacaatccatggaatatcagctgggtatccggtgtcggctccaacttcaccgatttcctgcacactcgtctggatgaagaagcatacagccagacgaatacaggcgttgttctgcctggagccatggttagcggaccgaatatcaaagatccgaataacaaattgagctctagcccttggtatgaggataaacctatttgggcagatgacaccaatcaatggagatacaacgaatatagtgtcagtatacagacgggattattctacaccatcatgggcttgtcggcccttggcggaaatgcatccactggtggcgcggagcccgttaagctgccgatcacttggcctatcattggggattatgtgactggggatgtgacggtattcgcacagccggaaggcagcttgagcaatgtgtcagcgaacggaatcgtcttgagcccctccgacggtgtctatacgacgacagtaagcacaagcgctgatgcaccatataccgaaagaaaagtacagatcaaagggacggacgacagcggattcaccacttatagcaatacacatttcacggtggcgcctgcacttccggatccatctcatcctttacttttcgatgactttaaccagaaaggaatctggggtagccaaaagctggattgggtgaattggtataaccaaaacggaggtacagcatcctacacgcggacgacagtggatacaagaacagttgggaaatttgcacatacccctgcagccactacatccaaagccaaattccagccgtggaaatacaacgcaaatcttaacggatatcgctatcttaatttcaccatgaagaatccgggttatcccaataccaaaattcggatagcagcgaatgacggcaccaaatcagttaaccttacgagcggcgaggttgcgatctcgagcacgtggacaacgtatcaatatgatttgaatctgcatccgacgctgaacaagagcaacgttctgattgaggtatggctcagcaacccaactgcgggggcatatggggaaattctcattgacgaaatctcggctgtgaatacgaacagcggaacggcgccaaccttatccgccacaggtgtgaacgcctcgatcggtaatcagtcgacggtatttacttatacagcgacctacaccgatgctaataatcaagcgccgtttgatgtccaggtcgtcattgacggcgtcatccgttcgatgacggcggcggatcctactgacactacttattccgatgggagagtgtatacgtacgctactaccttgccggtggggacgcataagttttacttccggacgacagatacaaccacgaacttcgtcagcacttccgtgcaaaccggaccaaccgtcattcggaataaactggaggcggaagtcctttctatcaacttaacgaattatacacatgctgtaaaagacaatgcggatgcgagcggagggaagtatcgcttgttcaatggtcggcaggccaacgattatattgaatatgcggtgaatgtccctaaggctggaacatatcaagtatctgccagagccatgagattaagcgacaatgggatctaccagctgcagattaacggcagcaatcaaggtactccgttcgatacttaccagtcatcggggaagtatcttgactatgctcttggaaatgtgaccataactagcccgggaacgcagttatttcgattcaaagtaacgggcaaaaatgcaagctcactcggatataagctgccgcttgatttcattcagcttgttccagttccgtaa

SEQ ID NO: 2 - protein, 1093 aa, Paenibacillus sp.
MVFNQNVQMFYRRWVSLLLAMLMTVLAPLTIMVDNAHAIAGVVQSVNVSQAGYSSNDFKTATVTASDKLSDTSYQILQGTTVIATGTMKDEGYVWGKYVYSIDFSSVTATGTNFTIRSNGVSSYTFPIQTNMWNEYKDEMTAFYRLLRTTDTFAAYPAGYSNIAPSNKILHPDSFLDDAFSPDRTTHYDLTGGWFDAGDYGKYGGNQWVQGNIAISYLRHASSAAVNFDKDTNGIPDLVDEAIFGSQYLVKFANQLGGAIHNILRKGGFVLPHKVTDNVPGNTDDRALEAVEAVGGSGKSSGSLAATARAIRTAIAGGKVAANKVAQLQTLANEFQAAAIIFYNYTLTHQSGNHGSYGTMNNGGIANPLLWAEVQLYLLTGDAAYKTQAQTRINAINEAYVSSTNYWDMHPIALAEFYPVADSAIKTKIQSILKHQAYYFITLMDETPYGVLNQFGNFGVNEPHASYMADLLRYYELFNDPVALRAAKKALYWIVGNNPWNISWVSGVGSNFTDFLHTRLDEEAYSQTNTGVVLPGAMVSGPNIKDPNNKLSSSPWYEDKPIWADDTNQWRYNEYSVSIQTGLFYTIMGLSALGGNASTGGAEPVKLPITWPIIGDYVTGDVTVFAQPEGSLSNVSANGIVLSPSDGVYTTTVSTSADAPYTERKVQIKGTDDSGFTTYSNTHFTVAPALPDPSHPLLFDDFNQKGIWGSQKLDWVNWYNQNGGTASYTRTTVDTRTVGKFAHTPAATTSKAKFQPWKYNANLNGYRYLNFTMKNPGYPNTKIRIAANDGTKSVNLTSGEVAISSTWTTYQYDLNLHPTLNKSNVLIEVWLSNPTAGAYGEILIDEISAVNTNSGTAPTLSATGVNASIGNQSTVFTYTATYTDANNQAPFDVQVVIDGVIRSMTAADPTDTTYSDGRVYTYATTLPVGTHKFYFRTTDTTTNFVSTSVQTGPTVIRNKLEAEVLSINLTNYTHAVKDNADASGGKYRLFNGRQANDYIEYAVNVPKAGTYQVSARAMRLSDNGIYQLQINGSNQGTPFDTYQSSGKYLDYALGNVTITSPGTQLFRFKVTGKNASSLGYKLPLDFIQLVPVP

SEQ ID NO: 3 - DNA, 2376 bp, Paenibacillus sp.
  CDS (1)..(2373)
  sig_peptide (1)..(93)
  mat_peptide (94)..(2373)
atgttgaagcaagggatgaaaagatggacaagcgtttgtctggctatcatcatgttcagtctgacttttttgaatgcgggaactgtaccgagagcggaggcgtccgacatgttcgacgagcttagagaaaagtatgcaaccatgctgaccggagggacggcgtatagtctgtccgatccggatatcgccgcgcgggtggcgtcgattacgaccaacgcgcagacactgtggacctccatgaagaaggatgcgaacagagtgcggttatgggacaacgcgccgctcggcaacgattcggcgagcattacgaccagctaccggcagcttgcggccatggcgctcgcttaccgcacgtatggctccagcctgatgggtgatcccgacttgcgcgatgacattatcgacgggctggactggataaatacgttccagcacggcttctgcgaaggctgcagcatgtatcagaactggtggcattggcagatcggcggcccgattgcgcttaatgaagtcatcgcgcttatgtacgacgagctgacgcagacgcaaatcgacagctacatagcggcgatcaactatgcgcagccgagcgtgaacatgaccggggcaaacaggctttgggaaagccaggttatcgctttggcgggcatcaacggcaagaacggcgacaagatcgcgcatgcccgggacgggctgagcgcgctgctgacgtacgttgtgcagggggacggcttttacgaggacggctcgttcgtccagcattcctactactcctacaacggcgggtacggcctggatttgctgaagggcattgccgacttgacttatttgctgcacgactcgaactgggaagtcgtcgatccgaacaagcagaacattttcaactgggtatacgattccttcgagccgtttatttataacggaaatctgatggacatggtgcgggggcgggaaatatcgcggcatgcgaggcaaagcaacgtcgttggcgtcgaggccgtcgccgccattctgcgcttgtcccatgtagctccgcctgcggacgcggcagccttcaagagcatggtcaagcattggctccaggaaggcgggggaagccaattcctgcagcaagcttcgattacgcatatattgagcgcgcaggacgttctgaacgattccggcatcgtccctagaggcgaactggaagcttaccgccagtttgccggcatggaccgggcgctgcagctgcggcagggctacggcttcggcatcagcatgttttccagccggatcggcggccatgaagccattaacgcggagaacaacaaaggctggcataccggcgcgggcatgacttacttgtacaacaacgacttgagccagttcaacgatcatttctggccgactgtcaacagctaccggctgcccggtacgacggtgctgcgcgacacgccgcaagcggccaatacgcgaggcgacagatcctgggcgggcggtacggatatgctgggactatacggcataaccggtatggaatatcatgcaatcggcaaaagcttgaccgccaagaagtcctggttcatgtttgacgacgaaatcgtcgctctcggagcggacataacaagcggcgacggcgttgccgtcgaaacgatcgtcgaaaaccgcaagctgaacggtgcgggagacaattcgcttacggtgaacggcacggccaagccggcaacgctcggctggtcggagacgatgggcacgacaagctacgcacatcttgggggcagcgttgccgactcggatatcggctactacttcccggatggcggagcgacgctgcatgcccttcgcgaagcgcgcacaggcaattggcggcaaataaactcggcccagggctcgcccaatgcgccgcatacgcgaaactatttgaccatgtggctggagcatggcgtgaatccgtcgaatggggcttactcgtatgtgctgctgccgaacaagacgagcgcagcgacggcaagctatgctgcttcgcccgatattacgattattgaaaactcttcctccgcccaggcggtgaaggaaaacggcctcaatatgatcggcgtgaacttctggaataatgagcgaaagacggcagggggcattacttcgaatgccaaagcgtcggtcatgacgcgggaaacggcaagcgagttgaatgtatcggtgtccgatccgacgcagagcaatgtcggcatgatctatatcgagatcgacaaaagcgcaacggggcttattgcgaaggacgatgccgttacggtgctgcaatacagtccaacgatcaaattcaaggttgatgtgaacaaggcgcgcggcaagtcattcaaggcggcattcagcctgaccggcgcgcagcagccgtaa

SEQ ID NO: 4 - protein, 791 aa, Paenibacillus sp.
MLKQGMKRWTSVCLAIIMFSLTFLNAGTVPRAEASDMFDELREKYATMLTGGTAYSLSDPDIAARVASITTNAQTLWTSMKKDANRVRLWDNAPLGNDSASITTSYRQLAAMALAYRTYGSSLMGDPDLRDDIIDGLDWINTFQHGFCEGCSMYQNWWHWQIGGPIALNEVIALMYDELTQTQIDSYIAAINYAQPSVNMTGANRLWESQVIALAGINGKNGDKIAHARDGLSALLTYVVQGDGFYEDGSFVQHSYYSYNGGYGLDLLKGIADLTYLLHDSNWEVVDPNKQNIFNWVYDSFEPFIYNGNLMDMVRGREISRHARQSNVVGVEAVAAILRLSHVAPPADAAAFKSMVKHWLQEGGGSQFLQQASITHILSAQDVLNDSGIVPRGELEAYRQFAGMDRALQLRQGYGFGISMFSSRIGGHEAINAENNKGWHTGAGMTYLYNNDLSQFNDHFWPTVNSYRLPGTTVLRDTPQAANTRGDRSWAGGTDMLGLYGITGMEYHAIGKSLTAKKSWFMFDDEIVALGADITSGDGVAVETIVENRKLNGAGDNSLTVNGTAKPATLGWSETMGTTSYAHLGGSVADSDIGYYFPDGGATLHALREARTGNWRQINSAQGSPNAPHTRNYLTMWLEHGVNPSNGAYSYVLLPNKTSAATASYAASPDITIIENSSSAQAVKENGLNMIGVNFWNNERKTAGGITSNAKASVMTRETASELNVSVSDPTQSNVGMIYIEIDKSATGLIAKDDAVTVLQYSPTIKFKVDVNKARGKSFKAAFSLTGAQQP

SEQ ID NO: 5 - DNA, 3273 bp, Artificial Sequence
  Synthetic construct
  CDS (1)..(3270)
  sig_peptide (1)..(81)
  mat_peptide (82)..(3270)
atgaagaaaccgttggggaaaattgtcgcaagcaccgcactactcatttctgttgcttttagttcatcgatagcatcagcacatcatcatcaccatcatcctaggatcgcaggcgtggttcaaagcgtgaatgtctcccaagctggttatagttcaaacgattttaagacggctacggtgactgcgtcggataaactaagcgatactagctaccagatattgcaaggcactaccgttatcgcaaccggtacgatgaaggatgaaggatatgtatggggcaaatatgtgtactcgatcgatttctcctccgttacagctacgggcaccaactttacgatccgtagcaacggagtttcatcttacacgttccctatccaaaccaatatgtggaatgaatataaggatgaaatgaccgcgttctaccgtttgctccggactacggatacctttgcggcctatcctgcagggtacagcaatattgcgccttcgaataaaatattacatccggattctttccttgatgatgctttttcgccggaccgaacgacgcattatgacctgactggcggttggttcgatgcaggagactacggtaagtatggcggcaatcagtgggtacagggaaatatcgccatctcttatctgcggcatgcctcttcggcggcggtcaatttcgataaggataccaacggcattccggatctggtggatgaagcgatctttggtagtcagtacttggtgaagtttgccaatcagcttggcggggccattcataatattttgaggaaaggcggctttgtgcttccgcataaagtgacagacaatgttccgggtaacacagacgaccgagcgctcgaagctgtcgaagcggtgggaggctccgggaaatcctctggctcgctggcggcaacggcgcgagcgattcgcactgccatcgcgggcggtaaagtggcagcgaataaagtcgcccagctgcagacacttgcgaatgagtttcaggctgccgcaatcatcttctataattacacattgactcatcaaagtggaaaccatggctcctatggaacaatgaacaatggagggattgcaaatcctctcttatgggcggaagtacagttgtatctgttaacaggggacgctgcatacaagacgcaagctcagacacgcattaatgcaataaatgaagcctatgtttcgtccacgaattattgggatatgcatccgattgcgctggccgaattttatccggtcgcggacagcgcgatcaaaaccaaaattcaaagtatcctgaagcaccaagcatattatttcatcacgctgatggatgaaacgccatacggtgtattgaaccaattcggcaattttggtgtgaatgagccgcatgcatcgtatatggccgatttgctccgatattatgaattgtttaacgatccggtagcgcttcgagcggcgaagaaggcgctgtactggattgtcggcaacaatccatggaatatcagctgggtatccggtgtcggctccaacttcaccgatttcctgcacactcgtctggatgaagaagcatacagccagacgaatacaggcgttgttctgcctggagccatggttagcggaccgaatatcaaagatccgaataacaaattgagctctagcccttggtatgaggataaacctatttgggcagatgacaccaatcaatggagatacaacgaatatagtgtcagtatacagacgggattattctacaccatcatgggcttgtcggcccttggcggaaatgcatccactggtggcgcggagcccgttaagctgccgatcacttggcctatcattggggattatgtgactggggatgtgacggtattcgcacagccggaaggcagcttgagcaatgtgtcagcgaacggaatcgtcttgagcccctccgacggtgtctatacgacgacagtaagcacaagcgctgatgcaccatataccgaaagaaaagtacagatcaaagggacggacgacagcggattcaccacttatagcaatacacatttcacggtggcgcctgcacttccggatccatctcatcctttacttttcgatgactttaaccagaaaggaatctggggtagccaaaagctggattgggtgaattggtataaccaaaacggaggtacagcatcctacacgcggacgacagtggatacaagaacagttgggaaatttgcacatacccctgcagccactacatccaaagccaaattccagccgtggaaatacaacgcaaatcttaacggatatcgctatcttaatttcaccatgaagaatccgggttatcccaataccaaaattcggatagcagcgaatgacggcaccaaatcagttaaccttacgagcggcgaggttgcgatctcgagcacgtggacaacgtatcaatatgatttgaatctgcatccgacgctgaacaagagcaacgttctgattgaggtatggctcagcaacccaactgcgggggcatatggggaaattctcattgacgaaatctcggctgtgaatacgaacagcggaacggcgccaaccttatccgccacaggtgtgaacgcctcgatcggtaatcagtcgacggtatttacttatacagcgacctacaccgatgctaataatcaagcgccgtttgatgtccaggtcgtcattgacggcgtcatccgttcgatgacggcggcggatcctactgacactacttattccgatgggagagtgtatacgtacgctactaccttgccggtggggacgcataagttttacttccggacgacagatacaaccacgaacttcgtcagcacttccgtgcaaaccggaccaaccgtcattcggaataaactggaggcggaagtcctttctatcaacttaacgaattatacacatgctgtaaaagacaatgcggatgcgagcggagggaagtatcgcttgttcaatggtcggcaggccaacgattatattgaatatgcggtgaatgtccctaaggctggaacatatcaagtatctgccagagccatgagattaagcgacaatgggatctaccagctgcagattaacggcagcaatcaaggtactccgttcgatacttaccagtcatcggggaagtatcttgactatgctcttggaaatgtgaccataactagcccgggaacgcagttatttcgattcaaagtaacgggcaaaaatgcaagctcactcggatataagctgccgcttgatttcattcagcttgttccagttccgtaa

SEQ ID NO: 6 - protein, 1090 aa, Artificial Sequence
  Synthetic Construct
MKKPLGKIVASTALLISVAFSSSIASAHHHHHHPRIAGVVQSVNVSQAGYSSNDFKTATVTASDKLSDTSYQILQGTTVIATGTMKDEGYVWGKYVYSIDFSSVTATGTNFTIRSNGVSSYTFPIQTNMWNEYKDEMTAFYRLLRTTDTFAAYPAGYSNIAPSNKILHPDSFLDDAFSPDRTTHYDLTGGWFDAGDYGKYGGNQWVQGNIAISYLRHASSAAVNFDKDTNGIPDLVDEAIFGSQYLVKFANQLGGAIHNILRKGGFVLPHKVTDNVPGNTDDRALEAVEAVGGSGKSSGSLAATARAIRTAIAGGKVAANKVAQLQTLANEFQAAAIIFYNYTLTHQSGNHGSYGTMNNGGIANPLLWAEVQLYLLTGDAAYKTQAQTRINAINEAYVSSTNYWDMHPIALAEFYPVADSAIKTKIQSILKHQAYYFITLMDETPYGVLNQFGNFGVNEPHASYMADLLRYYELFNDPVALRAAKKALYWIVGNNPWNISWVSGVGSNFTDFLHTRLDEEAYSQTNTGVVLPGAMVSGPNIKDPNNKLSSSPWYEDKPIWADDTNQWRYNEYSVSIQTGLFYTIMGLSALGGNASTGGAEPVKLPITWPIIGDYVTGDVTVFAQPEGSLSNVSANGIVLSPSDGVYTTTVSTSADAPYTERKVQIKGTDDSGFTTYSNTHFTVAPALPDPSHPLLFDDFNQKGIWGSQKLDWVNWYNQNGGTASYTRTTVDTRTVGKFAHTPAATTSKAKFQPWKYNANLNGYRYLNFTMKNPGYPNTKIRIAANDGTKSVNLTSGEVAISSTWTTYQYDLNLHPTLNKSNVLIEVWLSNPTAGAYGEILIDEISAVNTNSGTAPTLSATGVNASIGNQSTVFTYTATYTDANNQAPFDVQVVIDGVIRSMTAADPTDTTYSDGRVYTYATTLPVGTHKFYFRTTDTTTNFVSTSVQTGPTVIRNKLEAEVLSINLTNYTHAVKDNADASGGKYRLFNGRQANDYIEYAVNVPKAGTYQVSARAMRLSDNGIYQLQINGSNQGTPFDTYQSSGKYLDYALGNVTITSPGTQLFRFKVTGKNASSLGYKLPLDFIQLVPVP

SEQ ID NO: 7 - DNA, 2388 bp, Artificial Sequence
  Synthetic construct
  CDS (1)..(2385)
  sig_peptide (1)..(81)
  mat_peptide (82)..(2385)
atgaagaaaccgttggggaaaattgtcgcaagcaccgcactactcatttctgttgcttttagttcatcgatagcatcagcacatcatcatcaccatcatcctagggcggaggcgtccgacatgttcgacgagcttagagaaaagtatgcaaccatgctgaccggagggacggcgtatagtctgtccgatccggatatcgccgcgcgggtggcgtcgattacgaccaacgcgcagacactgtggacctccatgaagaaggatgcgaacagagtgcggttatgggacaacgcgccgctcggcaacgattcggcgagcattacgaccagctaccggcagcttgcggccatggcgctcgcttaccgcacgtatggctccagcctgatgggtgatcccgacttgcgcgatgacattatcgacgggctggactggataaatacgttccagcacggcttctgcgaaggctgcagcatgtatcagaactggtggcattggcagatcggcggcccgattgcgcttaatgaagtcatcgcgcttatgtacgacgagctgacgcagacgcaaatcgacagctacatagcggcgatcaactatgcgcagccgagcgtgaacatgaccggggcaaacaggctttgggaaagccaggttatcgctttggcgggcatcaacggcaagaacggcgacaagatcgcgcatgcccgggacgggctgagcgcgctgctgacgtacgttgtgcagggggacggcttttacgaggacggctcgttcgtccagcattcctactactcctacaacggcgggtacggcctggatttgctgaagggcattgccgacttgacttatttgctgcacgactcgaactgggaagtcgtcgatccgaacaagcagaacattttcaactgggtatacgattccttcgagccgtttatttataacggaaatctgatggacatggtgcgggggcgggaaatatcgcggcatgcgaggcaaagcaacgtcgttggcgtcgaggccgtcgccgccattctgcgcttgtcccatgtagctccgcctgcggacgcggcagccttcaagagcatggtcaagcattggctccaggaaggcgggggaagccaattcctgcagcaagcttcgattacgcatatattgagcgcgcaggacgttctgaacgattccggcatcgtccctagaggcgaactggaagcttaccgccagtttgccggcatggaccgggcgctgcagctgcggcagggctacggcttcggcatcagcatgttttccagccggatcggcggccatgaagccattaacgcggagaacaacaaaggctggcataccggcgcgggcatgacttacttgtacaacaacgacttgagccagttcaacgatcatttctggccgactgtcaacagctaccggctgcccggtacgacggtgctgcgcgacacgccgcaagcggccaatacgcgaggcgacagatcctgggcgggcggtacggatatgctgggactatacggcataaccggtatggaatatcatgcaatcggcaaaagcttgaccgccaagaagtcctggttcatgtttgacgacgaaatcgtcgctctcggagcggacataacaagcggcgacggcgttgccgtcgaaacgatcgtcgaaaaccgcaagctgaacggtgcgggagacaattcgcttacggtgaacggcacggccaagccggcaacgctcggctggtcggagacgatgggcacgacaagctacgcacatcttgggggcagcgttgccgactcggatatcggctactacttcccggatggcggagcgacgctgcatgcccttcgcgaagcgcgcacaggcaattggcggcaaataaactcggcccagggctcgcccaatgcgccgcatacgcgaaactatttgaccatgtggctggagcatggcgtgaatccgtcgaatggggcttactcgtatgtgctgctgccgaacaagacgagcgcagcgacggcaagctatgctgcttcgcccgatattacgattattgaaaactcttcctccgcccaggcggtgaaggaaaacggcctcaatatgatcggcgtgaacttctggaataatgagcgaaagacggcagggggcattacttcgaatgccaaagcgtcggtcatgacgcgggaaacggcaagcgagttgaatgtatcggtgtccgatccgacgcagagcaatgtcggcatgatctatatcgagatcgacaaaagcgcaacggggcttattgcgaaggacgatgccgttacggtgctgcaatacagtccaacgatcaaattcaaggttgatgtgaacaaggcgcgcggcaagtcattcaaggcggcattcagcctgaccggcgcgcagcagccgtaa

SEQ ID NO: 8 - protein, 795 aa, Artificial Sequence
  Synthetic Construct
MKKPLGKIVASTALLISVAFSSSIASAHHHHHHPRAEASDMFDELREKYATMLTGGTAYSLSDPDIAARVASITTNAQTLWTSMKKDANRVRLWDNAPLGNDSASITTSYRQLAAMALAYRTYGSSLMGDPDLRDDIIDGLDWINTFQHGFCEGCSMYQNWWHWQIGGPIALNEVIALMYDELTQTQIDSYIAAINYAQPSVNMTGANRLWESQVIALAGINGKNGDKIAHARDGLSALLTYVVQGDGFYEDGSFVQHSYYSYNGGYGLDLLKGIADLTYLLHDSNWEVVDPNKQNIFNWVYDSFEPFIYNGNLMDMVRGREISRHARQSNVVGVEAVAAILRLSHVAPPADAAAFKSMVKHWLQEGGGSQFLQQASITHILSAQDVLNDSGIVPRGELEAYRQFAGMDRALQLRQGYGFGISMFSSRIGGHEAINAENNKGWHTGAGMTYLYNNDLSQFNDHFWPTVNSYRLPGTTVLRDTPQAANTRGDRSWAGGTDMLGLYGITGMEYHAIGKSLTAKKSWFMFDDEIVALGADITSGDGVAVETIVENRKLNGAGDNSLTVNGTAKPATLGWSETMGTTSYAHLGGSVADSDIGYYFPDGGATLHALREARTGNWRQINSAQGSPNAPHTRNYLTMWLEHGVNPSNGAYSYVLLPNKTSAATASYAASPDITIIENSSSAQAVKENGLNMIGVNFWNNERKTAGGITSNAKASVMTRETASELNVSVSDPTQSNVGMIYIEIDKSATGLIAKDDAVTVLQYSPTIKFKVDVNKARGKSFKAAFSLTGAQQP

SEQ ID NO: 9 - DNA, 3856 bp, Microbacterium sp.
  CDS (501)..(3353)
  sig_peptide (501)..(599)
  mat_peptide (600)..(3353)
cttcatctcgccgccctccgagagcacgtcgtcgatcccctccacgacgaagcggtagtagtaggaggtcggcatgacgacgccgatcgttcccgcgaaggccttcgtcgaggcgcgaccgggcaggggccgatcggcccgcagcacggcgccgccgcgcaccttctcgaggatttgctcggcgacgagcgagtccagatcacgacggatcgtcacgtgggacacgcccaggtcaccgacgagcgatgtgatccgcaccgccccgtcctgctgcgcacggctcagaattcgcgcgcgacgctcggcagcgagcatggcagtccccctccgcagcggaaatcgagtcccagcttaatctcggcgcccgtccgtgatcaggttgatcgcagaatgagctatttatttaagtttcgttctttatcttgccatttctttgcatccacgtcgatactggctcgcgtcgacggcgacgacgccgcggcatccccgaaggaggagtcatgactcgacgacgagcatcatccatctggaccgccacggcggtcgcgaccgccgtggcggtgggcggggcggtgatcgccgcgcccccggccgccgctgcgacgatcgaacgcgtcgccgtcagccaggcgggatacagcgcgaccgggcacaaggtcgggtcggtcatcagtgacggaccgctgcccggatcgacctcgtgccgcatcctgcaggggcagacggtcgtcgtcccgtcgtgcgccctgctcgatcgaggcaccacatggggtgatcgcgtctacgtcgtcgacttcagcaccctgaccaccgtggccgacgactacgcgctggaagtggggggcgtcctctcgccgcgcttctcggtgaccgagaacgtctgggccggctacctcgacgagatgaccgcgttctaccgcctgcagcgctccggcgtcgcgaccgcggacgcctaccccgcgggctacagcagcatcgccccctccgacaagatcttccacggccccgggcacctggatgacgccgcatccgccgacggaacggtgcactacgacctcaccggcggttggtacgacgccggcgactacggcacgtacggcggcaaccagtgggtgggcggcaacatcgcgatcacctacctgcgctacggcgacaacgccgacgtggccttcgacaacgacggcaacggcgtgcccgacctcgtcgacgagtcgcggttcggaagcgagtacctgctgcgcatgctggccgcgttcgacggcgccttctgggatgtgaagggcagcggcggcttccagcaccccgatgcgcacaccgacggcatcgtgggaacgaccgacgaccgtcgcatctcgggctacggcgtcggcgggtcggcgaaggccgccgggtcgctggcggcgaccgcgcgtgcggtcgagaaggcgatcgccgacggccgcatcccggcgaccgaagtgagcgagtggcaggccttcgcggccgaggccgaggcgggcgccgtggcgttctacgagtacgtcgacagccaccggtcggacccgatcggcggctactccacgacccgcggcgggatcgcgaactcgatgctgttcgccgaggtgcagctgcacctgctcaccggcgacgcggcctaccgcacctccgcggaggcgacgatcgccgcgaccgagtactcggtcctctccaacacgaactactgggacatggcaccgctgtcgatggccgagctgtacccggctgccaccgcgagcggcaagacgacgatccagcgctacctcaagaagcagctggactacttcctctcgacgaccgacgacaccccgtacggcgtcgtgaaccagttcaagaacttcggcgtcaacgagccgcacatctcctacgtcgccgatgcgatgcgctactacgagctgttcggagaccagcgggccctcaaggcggtccagcgcggcctctactgggtcttcggcaacaacccgtggggaacgagttgggtgtccggcgtgggcgagaactcggtgaaattcctccacacccgactcgacgaagaggcccagagccagaccgggaccggcgtcgtgctgcccggcgcgctcgtcagcggccccaatgccaaggacccgctcgatgtccgcagcgcgagcccctggtacgccgatcgtcccgtgtggcaggacagcggccagcagtggcgctacaacgagtacagcgtcagcatccagaccggcctcttctcgacgctcttcggcctcaccgcgctcggcgacgccgcctggtctgcgggcaccccgccgacggccctgaccgtgacgtcgccgctgatcggcgaccaggtcacgggcgatgtgaccgtgttcgcgcagagcggctcatcgctgacccagcacgcccttgggccgaactggacgccgatgacggcggccggcggggtctcgacgggcaccgtcaacgtggacgccctcgcgcccttcaccacggcgcggatcgatgcccgcgggacgcaggcgagcggtgcgtactcgtactcctcgacccactacacggtggcgcccccgctcccgagcccggacagtccgctgctgtacgacggattcggccgcgacggcgtgttcgggatgcagggctacacctgggtgaactggtacaacaaccacgccggcgtgggctcggccaccaacaccacggtcgacgggcgcacggtcgcacggctcttccagaacccggccaccgcgatgtcgcaggcgaagttccagccgtggcatcactcggtggatgcgagcggctatcgctatctgaccgtcacgatgcgcaccccgtcacccaatctgcgcctgcgcatcgaggtgtcggatgcggactcgaaccaccgggtgacgggcaacgcgccggtggcggtctcggcacagtggtcgacgtactcgttcgatctggcgcagttcgccgggctcgaccggtcgcaggccaagctggtgttctggctgcagcagaccgcggacaccgacggtgagctgttcgtcgacgaggtgagcttcaccaaccaggcagccggcaccgcgccgacgctgtccgcgatcacccacaccgcggggagcctcaccaccggcaccgatgtgaccgtgcaggcgacgtacaccgacgccgacggagaggcgccccacgcggtcgagctggtgctcgacggcgtgatccatcggatgacggcggtcgatcccgccgacaccgatgtgacggacggcgcggtctacgccgtcacgcggcggtgggtgaagggagtgcactcgtacgacgtgcgcacgaccgacaccacctcgagcgtggtgacctcgccgaccgtgaccggagtggtcgtcggatgaccgcgggcacgggggcgggccgcttcggcggtccgcccccgtgcgcgctcggctcaggcgatgatgcccagcgaggcgccgtcgacgcgatgccgcgccacccggccgtgcacgagggcgtcgaggtcatcgagcgccgagtcggccagacgccgcgtctcggcgtgcatcgcaccggcgatgtgagggctgagaacgatgccgggcgtgtcgaacagcggcgagtccggtcccaacggctcggggtccgtcacatccaggacggcccgcagcaggccggcacggcaccgcgccatgagcgcctcggtgtcgatgagcgagccgcgcgcggtgttgatcagcacggcatccgggcgcagcatccccaggcgacgggcgtcgaggaggcgtcgggtctcgggcagctccggagcgtggatggtgacgacgtcactggcacgcagcaggtcgtccaggtcggtcaggcgcgcgcccaccgcggcggcgtccgcggggtccgc

SEQ ID NO: 10 - protein, 951 aa, Microbacterium sp.
MTRRRASSIWTATAVATAVAVGGAVIAAPPAAAATIERVAVSQAGYSATGHKVGSVISDGPLPGSTSCRILQGQTVVVPSCALLDRGTTWGDRVYVVDFSTLTTVADDYALEVGGVLSPRFSVTENVWAGYLDEMTAFYRLQRSGVATADAYPAGYSSIAPSDKIFHGPGHLDDAASADGTVHYDLTGGWYDAGDYGTYGGNQWVGGNIAITYLRYGDNADVAFDNDGNGVPDLVDESRFGSEYLLRMLAAFDGAFWDVKGSGGFQHPDAHTDGIVGTTDDRRISGYGVGGSAKAAGSLAATARAVEKAIADGRIPATEVSEWQAFAAEAEAGAVAFYEYVDSHRSDPIGGYSTTRGGIANSMLFAEVQLHLLTGDAAYRTSAEATIAATEYSVLSNTNYWDMAPLSMAELYPAATASGKTTIQRYLKKQLDYFLSTTDDTPYGVVNQFKNFGVNEPHISYVADAMRYYELFGDQRALKAVQRGLYWVFGNNPWGTSWVSGVGENSVKFLHTRLDEEAQSQTGTGVVLPGALVSGPNAKDPLDVRSASPWYADRPVWQDSGQQWRYNEYSVSIQTGLFSTLFGLTALGDAAWSAGTPPTALTVTSPLIGDQVTGDVTVFAQSGSSLTQHALGPNWTPMTAAGGVSTGTVNVDALAPFTTARIDARGTQASGAYSYSSTHYTVAPPLPSPDSPLLYDGFGRDGVFGMQGYTWVNWYNNHAGVGSATNTTVDGRTVARLFQNPATAMSQAKFQPWHHSVDASGYRYLTVTMRTPSPNLRLRIEVSDADSNHRVTGNAPVAVSAQWSTYSFDLAQFAGLDRSQAKLVFWLQQTADTDGELFVDEVSFTNQAAGTAPTLSAITHTAGSLTTGTDVTVQATYTDADGEAPHAVELVLDGVIHRMTAVDPADTDVTDGAVYAVTRRWVKGVHSYDVRTTDTTSSVVTSPTVTGVVVG

SEQ ID NO: 11 - DNA, 3424 bp, Microbacterium sp.
  CDS (78)..(2921)
  sig_peptide (78)..(173)
  mat_peptide (174)..(2921)
tcttgcgatgtctttcttttcgtgatgatactgacgggtcgccggcgacgacgccgcgatgactcaaaggagacgtcatgactcgacgacgagcgagaatctggataggcggggcgacctccctcgccctggccgcgggaggagcgttcgtggccgcctcgccggctctggccgcgacgatcacacaggtcgcggtgagccaagcgggatacagcgcaagcgggttgaaggtgggttccgtcgtcgcggacggcccgctcgcgcccggcacgtcgtgtcgagttcttgaaggctccaccgtcgtcgtcccgtcctgtgcgctgaacgacgagggagtcgtgtggggcgaccgtgtctacaccgtggacttcaccgccctcgacactgtcggtaccgactacgttctcgaggtcgacggggtcgcctccccccacttccagatccaggacaacgtgtgggccggctacctcgatgagatgacggcgttctaccgactgcagcgctcaggtgtcgccaccgccgacgtgtacccgagtggctacagcagcatcgctccctccgcgaaggcgttccacggccccggccacctggacgacgccgcatcggaagacgggacgatccactacgacctcaccggtgggtggtacgacgccggcgactacggcatctacggcggcaatcagtgggtggggggcaacatcgccgtcagctacctgcggtacggggacacaccggcggtgtcgttcgacaacgacagcaacggcgttcccgacctcgtcgacgaggctcgcttcggtagcgaatacctcctccggatgctggatgccttcgacggcgggttctgggacgtgaagggcagcgggagcttccagcaccccgacaatcacaccgacggcatcgtgggcacgaaagacgaccgacggatctccggctacggcgtcggaggatcagcgaaagccgcgggaaccttggccgccacggctcgagctgtcgagaaggcgctcgacgacggagcgatccccgcggccgcggtgacggagtgggaggctttcgccgcgcggagccgtgcgggcgccgaagccttctacacctatgccgacacccaccgatccgaccccctcggcggatactccaccacgcggggcggcctcgacaactccttgctgttcgccgaagtcgagctgcacctcctgaccggagacgcgggctacaaggactccgccgaagccacgatcgcggcgaccgatttcaccatcctctccaacacgaactactgggacctcgcgccgctgtcgatggccgagttgtaccccgccgcttcgcccacggcccaggcgcagatccagtcgtacctgaagaagcagttggactacttcctcaccagcacggatgacaccccttacggcgtggtggaccagttcaagaacttcggggtcaacgagccgcatgtctcctacgtcgcggatgccctccgctactacgagctcttcggcgacgagcgcgcactggaagccgtccagcgcggcttgtactgggtgttcggcaacaacccctgggggacgagctgggtctccggagtcggcgagaagagcacgaagttccttcacacccgactggacgaggacgcccagaaccaggcgggtacaggaatcgtcatccccggcgctctcgtcagcggccccaacgccaaagaccctctcgacgtgaagagtggaagcccgtggtacgcggaccgccccgtctggcaggacagtggacagcagtggcggtacaacgaatacagcgtgagcattcaaacgggcctgttctccgccctgttcgggctgaccgcagtcggcgatgccccgtgggacgggggcacggaccccgcgcccctcgcggtgacgtcaccgcagaccggggactatgtcaccggcgacgtcaccgtcttcgcggacagtgatctcagcggtctcgcgctcggccccaattgggcccccatggcgacctccgccggcgtcgccaccggttccttcaacgtgaacggtgtcgctccgtacacgaacgcacgtgtggacgtgcgcggcacgcaggccgatggttcgcaggtctactcgtcggcgcattacacggtggctccaccgctcccgaacccgggcagtcccctgctgtacgacgggttcggcaaggacggcctgttcggagttcaggggtacgcctgggcgaattggtacaacaaccacgcgggggtcggttccgtcacgaacacgacggtcgatgggcgcacggtggggcggttcttccagaacccggcgacctccgcctcgcaggcgaagttccagccctggcatcactcggtggatgcgagcggataccgctatctcaccgtgacgatgcgctcgccttcgccgaacctgcgcttgcgcatcgaggtctccgacgcggactcgaaccaccgggtaaccggcaccgcaccgatcgccgtgtccaatggctggaacacctactcgttcgacctggcagcgttccccggcctggaccggtcgcaggcgaagatggtgttctggctgcagcagaccgcggacacggacggcgaactcctcgtggacgaagtcagcttcacgaaccaggcgagtggaaccgcgccgaccctgacggcgatctcccacaccggtgggtcgctgacgacggacgacgacgtcaccgttcaagcgacctacacggacgcgaacggtgaggcgccccacaaggtccagctggtcctggacggggtggttcgggacatgactgcggtcgattcatccgacaccgacgtgagtgacggaaaggtttattcgctcagcgggaagtgggtgaagggcgcgcacagctacttcgtacgcaccacggacaccacctctgaggtggtgtcctccccacccacgacgggggtggtcgttcagtagaccgagcgaagggcgggcccgtcgggcccgcccttcgtcgttcgaccgcccacagactccgcgcgcgtgacgccgtcgaaccgctgaacgtgcgatccgggcctagtcggcgccgcagcgcccgcgagacgaggcggcggcgtctcgcgcgttacgcggacagcccgagaagcgatcggtcgaccacgtggcggggcgcgctcccgcgcacgagtgcctcgagcccgtcgagggccgagtccgcaagacgcaaggtctcgcggtgcatggccccggcgatgtgcggggtgagaacgaccccgggagcgtcgaacagaggcgagtcggcgggtagcggctcggggtcggtgacgtccagcactgcacgaagcagaccgaggcggcatcgctcgatcagcgcttcggtgtccaccagtgccccgcgcgccgtgttgatgagcacagcaccaggccgcatcgcgccgatgcgtcgagcattcagaaggttgagagtggacggg

SEQ ID NO: 12 - protein, 948 aa, Microbacterium sp.
MTRRRARIWIGGATSLALAAGGAFVAASPALAATITQVAVSQAGYSASGLKVGSVVADGPLAPGTSCRVLEGSTVVVPSCALNDEGVVWGDRVYTVDFTALDTVGTDYVLEVDGVASPHFQIQDNVWAGYLDEMTAFYRLQRSGVATADVYPSGYSSIAPSAKAFHGPGHLDDAASEDGTIHYDLTGGWYDAGDYGIYGGNQWVGGNIAVSYLRYGDTPAVSFDNDSNGVPDLVDEARFGSEYLLRMLDAFDGGFWDVKGSGSFQHPDNHTDGIVGTKDDRRISGYGVGGSAKAAGTLAATARAVEKALDDGAIPAAAVTEWEAFAARSRAGAEAFYTYADTHRSDPLGGYSTTRGGLDNSLLFAEVELHLLTGDAGYKDSAEATIAATDFTILSNTNYWDLAPLSMAELYPAASPTAQAQIQSYLKKQLDYFLTSTDDTPYGVVDQFKNFGVNEPHVSYVADALRYYELFGDERALEAVQRGLYWVFGNNPWGTSWVSGVGEKSTKFLHTRLDEDAQNQAGTGIVIPGALVSGPNAKDPLDVKSGSPWYADRPVWQDSGQQWRYNEYSVSIQTGLFSALFGLTAVGDAPWDGGTDPAPLAVTSPQTGDYVTGDVTVFADSDLSGLALGPNWAPMATSAGVATGSFNVNGVAPYTNARVDVRGTQADGSQVYSSAHYTVAPPLPNPGSPLLYDGFGKDGLFGVQGYAWANWYNNHAGVGSVTNTTVDGRTVGRFFQNPATSASQAKFQPWHHSVDASGYRYLTVTMRSPSPNLRLRIEVSDADSNHRVTGTAPIAVSNGWNTYSFDLAAFPGLDRSQAKMVFWLQQTADTDGELLVDEVSFTNQASGTAPTLTAISHTGGSLTTDDDVTVQATYTDANGEAPHKVQLVLDGVVRDMTAVDSSDTDVSDGKVYSLSGKWVKGAHSYFVRTTDTTSEVVSSPPTTGVVVQ

SEQ ID NO: 13 - DNA, 3053 bp, Microbacterium sp.
  CDS (101)..(2953)
  sig_peptide (101)..(199)
  mat_peptide (200)..(2953)
ttacttgttcaaaagtatacaaaccttgcgtttggtttgtatatgtgtcgatactgaggcgctggcgatgacgccgactcaacccttcaaaggagaagtcatgtcccgacgacgagcgagttcgatgtggagaggggcggcggtcgtcacggcagtcgcgctgggtggggcggtgatcgctgcgccgcccgccgcagccgccaccatcgaggaagtcacggtgagccaggcgggctacagcgccggcggctacaaggtcggcttcgccgtggccgacggcgccgttccgggttcgacaagttgccgtatcctccagggtgagaccgttgtgctgccatcatgcacgcttctggatcgcggcacgacctggggcgcccgcgtgtaccaggtggacttcagtaccttcgacgacgtcggcgccgacttcgccctcgagatcggcggcgtgcgctccccgcgcttcgccgtcgagggaaacgtttggtccggctacctcgacgagatgaccgcgttttaccggctgcagcgctcaggcgtagataccgcggatgcctaccccgctggctacagcagcatcgccccctccgacaaggtcttccacgccgccggtcacctcgacgacgccgcgtccgaagacggcacgcagcactacgacctcactggcggctggtacgacgccggcgactacggcatctacggtggcaatcagtgggtcgcgggcaacatcgccatctcgtatctgcgctacggtgacacccctgaggtcgccttcgacggagactcgaacgatgtgcccgacctcgtcgacgaggcctggttcggcagcgaatacctgctccggatgctggatgcctttggcggccctttctgggacgtcaagggcagcggcggcttccagcatcccgaagatcacaccgacggagtgatcggcacggccgacgaccgtcgcatctccgggatgggcgtcggtggctctgcgaaggcggccggctcgctcgccgccaccgccagggcgatcagagccgccatcgacagcggtgacatcgccgcgggggatgccacggcctgggaggcttgggccaccgaagcggaggatggagcggtggcgttctacgagcacgccgacacgcaccgcggtgatccgctcggcgggtactcgaccacgcgcggcggcatcgacaactcccttctgtttgccgaagtgcagctctacctcctgacgggagatgtggcgtatcgcacgtcagccgaagcgacgatcgccgcgacgccgttcacgatcctgtccaatacgaactactgggacatggggccgctgtcgatggcggagctgtatcccgctgcgacggcgaccggcaagacgaatatccagcgctacctcaagaagcaactggactacgtgctttcttcgaccgatgacaccccttacggtgtcatcaaccagttcaagaacttcggtgtcaacgagccgcacgtgtcctacatggccgacgtgcttcgctactgggagctgttcggcgacgagcgtgcgctgcgagctgtgcagaagggaatgtactgggtgttcggcaacaacccctggggaacgagctgggtctcgggtgtgggcgagaagcacaccatgttcctgcacacgcggctcgacgagcaggcgcagacccagggcggaacgggaatcatcctgcctggcgcgctcgtgtcgggaccgaacgcgaaggacccgctcgatccgaccagcgccagcccctggtacgaagaccgctccggtttcgccgatgtcggccagcagtggcggtacaacgagtacagcgttagcatccaagccggacttttctcggccatgttcgggctcaccgctgccggtgatgcgccgtggtccagcgggacacctccgacggcgctgaccatcggatccccgcagatcggtcagtacgtcactgacgaggtgactgtcttcgcccagagcggctcatcgctcacggcgcacgcgctcggaccggactggacgccgatgacatcgtcagccggagtctcgaccggagtggtcgatgtgagcaacctcgcgccctacacgaacgcccgcatcgatgtgcgcggcacgcaggcgagcggagcgcacagctacagctccacccactacacggtcgcgccgcctctgccgacccccgacaccccgctgctctacgacggtttcgggcgcgacggtctgttcggcgtgcaggggtacacgtgggcgaactggtacaacaaccatgccggcgtgggtcaggtgaccaacagcaccgtggatggacgcaccgtgggccggttcttccacaatcccgccacggcgatgtcgcaggcgaagttccagccctggcatcactcggtggatgcggagggataccgctacttgtcggtgacgatgcgcagcccgtcaccgaatctccgcctgcggatcgaggtgtcggacggcgactcgaatcaccgcgtgaccgggacgacgccgatcgcgatctcgaacgactggaccacgtatgatttcgacctcgcggcgttccctggcctcgatcggtcgcaggccaagctcgtgttctggttgcagcagaccgccgacaccgacggcgagctgtttgtcgattccgtggagttcacgaacgatgcctccggtagcgcgccggggctctcggatgtcagccacacggccggcaccctgacaccgtctactccggtcacggtccaggcgacctacactgacgccgacggagccgctccatacgcggtcgagctcgtcgtcgacggggtgatccaccggatgtctcccgtcgaccccggtgataccgacatgaccgacggcgcgcagtactccgttgccgtgtcactcgtgaagggcgagcacagctacttcgtgcgcacgaccgacacgacctctgcggtggtcaggacaccggtggtgtccggcgtcgccgtcggctgatgagggaacggatgcggcggggagatcttcccccgccgcatccgtctgcctccggtccgctctaggttccccgtcgcgaggacgtcaggcgatgatg

SEQ ID NO: 14 - protein, 951 aa, Microbacterium sp.
MSRRRASSMWRGAAVVTAVALGGAVIAAPPAAAATIEEVTVSQAGYSAGGYKVGFAVADGAVPGSTSCRILQGETVVLPSCTLLDRGTTWGARVYQVDFSTFDDVGADFALEIGGVRSPRFAVEGNVWSGYLDEMTAFYRLQRSGVDTADAYPAGYSSIAPSDKVFHAAGHLDDAASEDGTQHYDLTGGWYDAGDYGIYGGNQWVAGNIAISYLRYGDTPEVAFDGDSNDVPDLVDEAWFGSEYLLRMLDAFGGPFWDVKGSGGFQHPEDHTDGVIGTADDRRISGMGVGGSAKAAGSLAATARAIRAAIDSGDIAAGDATAWEAWATEAEDGAVAFYEHADTHRGDPLGGYSTTRGGIDNSLLFAEVQLYLLTGDVAYRTSAEATIAATPFTILSNTNYWDMGPLSMAELYPAATATGKTNIQRYLKKQLDYVLSSTDDTPYGVINQFKNFGVNEPHVSYMADVLRYWELFGDERALRAVQKGMYWVFGNNPWGTSWVSGVGEKHTMFLHTRLDEQAQTQGGTGIILPGALVSGPNAKDPLDPTSASPWYEDRSGFADVGQQWRYNEYSVSIQAGLFSAMFGLTAAGDAPWSSGTPPTALTIGSPQIGQYVTDEVTVFAQSGSSLTAHALGPDWTPMTSSAGVSTGVVDVSNLAPYTNARIDVRGTQASGAHSYSSTHYTVAPPLPTPDTPLLYDGFGRDGLFGVQGYTWANWYNNHAGVGQVTNSTVDGRTVGRFFHNPATAMSQAKFQPWHHSVDAEGYRYLSVTMRSPSPNLRLRIEVSDGDSNHRVTGTTPIAISNDWTTYDFDLAAFPGLDRSQAKLVFWLQQTADTDGELFVDSVEFTNDASGSAPGLSDVSHTAGTLTPSTPVTVQATYTDADGAAPYAVELVVDGVIHRMSPVDPGDTDMTDGAQYSVAVSLVKGEHSYFVRTTDTTSAVVRTPVVSGVAVG

SEQ ID NO: 15 - DNA, 2862 bp, Artificial Sequence
  Synthetic construct
  CDS (1)..(2859)
  sig_peptide (1)..(81)
  mat_peptide (82)..(2859)
atgaagaaaccgttggggaaaattgtcgcaagcaccgcactactcatttctgttgcttttagttcatcgatagcatcagcacatcatcatcaccatcatcctagggcgacgatcgaacgcgtcgccgtcagccaggcgggatacagcgcgaccgggcacaaggtcgggtcggtcatcagtgacggaccgctgcccggatcgacctcgtgccgcatcctgcaggggcagacggtcgtcgtcccgtcgtgcgccctgctcgatcgaggcaccacatggggtgatcgcgtctacgtcgtcgacttcagcaccctgaccaccgtggccgacgactacgcgctggaagtggggggcgtcctctcgccgcgcttctcggtgaccgagaacgtctgggccggctacctcgacgagatgaccgcgttctaccgcctgcagcgctccggcgtcgcgaccgcggacgcctaccccgcgggctacagcagcatcgccccctccgacaagatcttccacggccccgggcacctggatgacgccgcatccgccgacggaacggtgcactacgacctcaccggcggttggtacgacgccggcgactacggcacgtacggcggcaaccagtgggtgggcggcaacatcgcgatcacctacctgcgctacggcgacaacgccgacgtggccttcgacaacgacggcaacggcgtgcccgacctcgtcgacgagtcgcggttcggaagcgagtacctgctgcgcatgctggccgcgttcgacggcgccttctgggatgtgaagggcagcggcggcttccagcaccccgatgcgcacaccgacggcatcgtgggaacgaccgacgaccgtcgcatctcgggctacggcgtcggcgggtcggcgaaggccgccgggtcgctggcggcgaccgcgcgtgcggtcgagaaggcgatcgccgacggccgcatcccggcgaccgaagtgagcgagtggcaggccttcgcggccgaggccgaggcgggcgccgtggcgttctacgagtacgtcgacagccaccggtcggacccgatcggcggctactccacgacccgcggcgggatcgcgaactcgatgctgttcgccgaggtgcagctgcacctgctcaccggcgacgcggcctaccgcacctccgcggaggcgacgatcgccgcgaccgagtactcggtcctctccaacacgaactactgggacatggcaccgctgtcgatggccgagctgtacccggctgccaccgcgagcggcaagacgacgatccagcgctacctcaagaagcagctggactacttcctctcgacgaccgacgacaccccgtacggcgtcgtgaaccagttcaagaacttcggcgtcaacgagccgcacatctcctacgtcgccgatgcgatgcgctactacgagctgttcggagaccagcgggccctcaaggcggtccagcgcggcctctactgggtcttcggcaacaacccgtggggaacgagttgggtgtccggcgtgggcgagaactcggtgaaattcctccacacccgactcgacgaagaggcccagagccagaccgggaccggcgtcgtgctgcccggcgcgctcgtcagcggccccaatgccaaggacccgctcgatgtccgcagcgcgagcccctggtacgccgatcgtcccgtgtggcaggacagcggccagcagtggcgctacaacgagtacagcgtcagcatccagaccggcctcttctcgacgctcttcggcctcaccgcgctcggcgacgccgcctggtctgcgggcaccccgccgacggccctgaccgtgacgtcgccgctgatcggcgaccaggtcacgggcgatgtgaccgtgttcgcgcagagcggctcatcgctgacccagcacgcccttgggccgaactggacgccgatgacggcggccggcggggtctcgacgggcaccgtcaacgtggacgccctcgcgcccttcaccacggcgcggatcgatgcccgcgggacgcaggcgagcggtgcgtactcgtactcctcgacccactacacggtggcgcccccgctcccgagcccggacagtccgctgctgtacgacggattcggccgcgacggcgtgttcgggatgcagggctacacctgggtgaactggtacaacaaccacgccggcgtgggctcggccaccaacaccacggtcgacgggcgcacggtcgcacggctcttccagaacccggccaccgcgatgtcgcaggcgaagttccagccgtggcatcactcggtggatgcgagcggctatcgctatctgaccgtcacgatgcgcaccccgtcacccaatctgcgcctgcgcatcgaggtgtcggatgcggactcgaaccaccgggtgacgggcaacgcgccggtggcggtctcggcacagtggtcgacgtactcgttcgatctggcgcagttcgccgggctcgaccggtcgcaggccaagctggtgttctggctgcagcagaccgcggacaccgacggtgagctgttcgtcgacgaggtgagcttcaccaaccaggcagccggcaccgcgccgacgctgtccgcgatcacccacaccgcggggagcctcaccaccggcaccgatgtgaccgtgcaggcgacgtacaccgacgccgacggagaggcgccccacgcggtcgagctggtgctcgacggcgtgatccatcggatgacggcggtcgatcccgccgacaccgatgtgacggacggcgcggtctacgccgtcacgcggcggtgggtgaagggagtgcactcgtacgacgtgcgcacgaccgacaccacctcgagcgtggtgacctcgccgaccgtgaccggagtggtcgtcggatga

SEQ ID NO: 16 - protein, 953 aa, Artificial Sequence
  Synthetic Construct
MKKPLGKIVASTALLISVAFSSSIASAHHHHHHPRATIERVAVSQAGYSATGHKVGSVISDGPLPGSTSCRILQGQTVVVPSCALLDRGTTWGDRVYVVDFSTLTTVADDYALEVGGVLSPRFSVTENVWAGYLDEMTAFYRLQRSGVATADAYPAGYSSIAPSDKIFHGPGHLDDAASADGTVHYDLTGGWYDAGDYGTYGGNQWVGGNIAITYLRYGDNADVAFDNDGNGVPDLVDESRFGSEYLLRMLAAFDGAFWDVKGSGGFQHPDAHTDGIVGTTDDRRISGYGVGGSAKAAGSLAATARAVEKAIADGRIPATEVSEWQAFAAEAEAGAVAFYEYVDSHRSDPIGGYSTTRGGIANSMLFAEVQLHLLTGDAAYRTSAEATIAATEYSVLSNTNYWDMAPLSMAELYPAATASGKTTIQRYLKKQLDYFLSTTDDTPYGVVNQFKNFGVNEPHISYVADAMRYYELFGDQRALKAVQRGLYWVFGNNPWGTSWVSGVGENSVKFLHTRLDEEAQSQTGTGVVLPGALVSGPNAKDPLDVRSASPWYADRPVWQDSGQQWRYNEYSVSIQTGLFSTLFGLTALGDAAWSAGTPPTALTVTSPLIGDQVTGDVTVFAQSGSSLTQHALGPNWTPMTAAGGVSTGTVNVDALAPFTTARIDARGTQASGAYSYSSTHYTVAPPLPSPDSPLLYDGFGRDGVFGMQGYTWVNWYNNHAGVGSATNTTVDGRTVARLFQNPATAMSQAKFQPWHHSVDASGYRYLTVTMRTPSPNLRLRIEVSDADSNHRVTGNAPVAVSAQWSTYSFDLAQFAGLDRSQAKLVFWLQQTADTDGELFVDEVSFTNQAAGTAPTLSAITHTAGSLTTGTDVTVQATYTDADGEAPHAVELVLDGVIHRMTAVDPADTDVTDGAVYAVTRRWVKGVHSYDVRTTDTTSSVVTSPTVTGVVVG

SEQ ID NO: 17 - DNA, 2856 bp, Artificial Sequence
  Synthetic construct
  CDS (1)..(2853)
  sig_peptide (1)..(81)
  mat_peptide (82)..(2853)
atgaagaaaccgttggggaaaattgtcgcaagcaccgcactactcatttctgttgcttttagttcatcgatagcatcagcacatcatcatcaccatcatcctagggcgacgatcacacaggtcgcggtgagccaagcgggatacagcgcaagcgggttgaaggtgggttccgtcgtcgcggacggcccgctcgcgcccggcacgtcgtgtcgagttcttgaaggctccaccgtcgtcgtcccgtcctgtgcgctgaacgacgagggagtcgtgtggggcgaccgtgtctacaccgtggacttcaccgccctcgacactgtcggtaccgactacgttctcgaggtcgacggggtcgcctccccccacttccagatccaggacaacgtgtgggccggctacctcgatgagatgacggcgttctaccgactgcagcgctcaggtgtcgccaccgccgacgtgtacccgagtggctacagcagcatcgctccctccgcgaaggcgttccacggccccggccacctggacgacgccgcatcggaagacgggacgatccactacgacctcaccggtgggtggtacgacgccggcgactacggcatctacggcggcaatcagtgggtggggggcaacatcgccgtcagctacctgcggtacggggacacaccggcggtgtcgttcgacaacgacagcaacggcgttcccgacctcgtcgacgaggctcgcttcggtagcgaatacctcctccggatgctggatgccttcgacggcgggttctgggacgtgaagggcagcgggagcttccagcaccccgacaatcacaccgacggcatcgtgggcacgaaagacgaccgacggatctccggctacggcgtcggaggatcagcgaaagccgcgggaaccttggccgccacggctcgagctgtcgagaaggcgctcgacgacggagcgatccccgcggccgcggtgacggagtgggaggctttcgccgcgcggagccgtgcgggcgccgaagccttctacacctatgccgacacccaccgatccgaccccctcggcggatactccaccacgcggggcggcctcgacaactccttgctgttcgccgaagtcgagctgcacctcctgaccggagacgcgggctacaaggactccgccgaagccacgatcgcggcgaccgatttcaccatcctctccaacacgaactactgggacctcgcgccgctgtcgatggccgagttgtaccccgccgcttcgcccacggcccaggcgcagatccagtcgtacctgaagaagcagttggactacttcctcaccagcacggatgacaccccttacggcgtggtggaccagttcaagaacttcggggtcaacgagccgcatgtctcctacgtcgcggatgccctccgctactacgagctcttcggcgacgagcgcgcactggaagccgtccagcgcggcttgtactgggtgttcggcaacaacccctgggggacgagctgggtctccggagtcggcgagaagagcacgaagttccttcacacccgactggacgaggacgcccagaaccaggcgggtacaggaatcgtcatccccggcgctctcgtcagcggccccaacgccaaagaccctctcgacgtgaagagtggaagcccgtggtacgcggaccgccccgtctggcaggacagtggacagcagtggcggtacaacgaatacagcgtgagcattcaaacgggcctgttctccgccctgttcgggctgaccgcagtcggcgatgccccgtgggacgggggcacggaccccgcgcccctcgcggtgacgtcaccgcagaccggggactatgtcaccggcgacgtcaccgtcttcgcggacagtgatctcagcggtctcgcgctcggccccaattgggcccccatggcgacctccgccggcgtcgccaccggttccttcaacgtgaacggtgtcgctccgtacacgaacgcacgtgtggacgtgcgcggcacgcaggccgatggttcgcaggtctactcgtcggcgcattacacggtggctccaccgctcccgaacccgggcagtcccctgctgtacgacgggttcggcaaggacggcctgttcggagttcaggggtacgcctgggcgaattggtacaacaaccacgcgggggtcggttccgtcacgaacacgacggtcgatgggcgcacggtggggcggttcttccagaacccggcgacctccgcctcgcaggcgaagttccagccctggcatcactcggtggatgcgagcggataccgctatctcaccgtgacgatgcgctcgccttcgccgaacctgcgcttgcgcatcgaggtctccgacgcggactcgaaccaccgggtaaccggcaccgcaccgatcgccgtgtccaatggctggaacacctactcgttcgacctggcagcgttccccggcctggaccggtcgcaggcgaagatggtgttctggctgcagcagaccgcggacacggacggcgaactcctcgtggacgaagtcagcttcacgaaccaggcgagtggaaccgcgccgaccctgacggcgatctcccacaccggtgggtcgctgacgacggacgacgacgtcaccgttcaagcgacctacacggacgcgaacggtgaggcgccccacaaggtccagctggtcctggacggggtggttcgggacatgactgcggtcgattcatccgacaccgacgtgagtgacggaaaggtttattcgctcagcgggaagtgggtgaagggcgcgcacagctacttcgtacgcaccacggacaccacctctgaggtggtgtcctccccacccacgacgggggtggtcgttcagtag

SEQ ID NO: 18 - protein, 951 aa, Artificial Sequence
  Synthetic Construct
MKKPLGKIVASTALLISVAFSSSIASAHHHHHHPRATITQVAVSQAGYSASGLKVGSVVADGPLAPGTSCRVLEGSTVVVPSCALNDEGVVWGDRVYTVDFTALDTVGTDYVLEVDGVASPHFQIQDNVWAGYLDEMTAFYRLQRSGVATADVYPSGYSSIAPSAKAFHGPGHLDDAASEDGTIHYDLTGGWYDAGDYGIYGGNQWVGGNIAVSYLRYGDTPAVSFDNDSNGVPDLVDEARFGSEYLLRMLDAFDGGFWDVKGSGSFQHPDNHTDGIVGTKDDRRISGYGVGGSAKAAGTLAATARAVEKALDDGAIPAAAVTEWEAFAARSRAGAEAFYTYADTHRSDPLGGYSTTRGGLDNSLLFAEVELHLLTGDAGYKDSAEATIAATDFTILSNTNYWDLAPLSMAELYPAASPTAQAQIQSYLKKQLDYFLTSTDDTPYGVVDQFKNFGVNEPHVSYVADALRYYELFGDERALEAVQRGLYWVFGNNPWGTSWVSGVGEKSTKFLHTRLDEDAQNQAGTGIVIPGALVSGPNAKDPLDVKSGSPWYADRPVWQDSGQQWRYNEYSVSIQTGLFSALFGLTAVGDAPWDGGTDPAPLAVTSPQTGDYVTGDVTVFADSDLSGLALGPNWAPMATSAGVATGSFNVNGVAPYTNARVDVRGTQADGSQVYSSAHYTVAPPLPNPGSPLLYDGFGKDGLFGVQGYAWANWYNNHAGVGSVTNTTVDGRTVGRFFQNPATSASQAKFQPWHHSVDASGYRYLTVTMRSPSPNLRLRIEVSDADSNHRVTGTAPIAVSNGWNTYSFDLAAFPGLDRSQAKMVFWLQQTADTDGELLVDEVSFTNQASGTAPTLTAISHTGGSLTTDDDVTVQATYTDANGEAPHKVQLVLDGVVRDMTAVDSSDTDVSDGKVYSLSGKWVKGAHSYFVRTTDTTSEVVSSPPTTGVVVQ

SEQ ID NO: 19 - DNA, 2862 bp, Artificial Sequence
  Synthetic construct
  CDS (1)..(2859)
  sig_peptide (1)..(81)
  mat_peptide (82)..(2859)
atgaagaaaccgttggggaaaattgtcgcaagcaccgcactactcatttctgttgcttttagttcatcgatagcatcagcacatcatcatcaccatcatcctagggccaccatcgaggaagtcacggtgagccaggcgggctacagcgccggcggctacaaggtcggcttcgccgtggccgacggcgccgttccgggttcgacaagttgccgtatcctccagggtgagaccgttgtgctgccatcatgcacgcttctggatcgcggcacgacctggggcgcccgcgtgtaccaggtggacttcagtaccttcgacgacgtcggcgccgacttcgccctcgagatcggcggcgtgcgctccccgcgcttcgccgtcgagggaaacgtttggtccggctacctcgacgagatgaccgcgttttaccggctgcagcgctcaggcgtagataccgcggatgcctaccccgctggctacagcagcatcgccccctccgacaaggtcttccacgccgccggtcacctcgacgacgccgcgtccgaagacggcacgcagcactacgacctcactggcggctggtacgacgccggcgactacggcatctacggtggcaatcagtgggtcgcgggcaacatcgccatctcgtatctgcgctacggtgacacccctgaggtcgccttcgacggagactcgaacgatgtgcccgacctcgtcgacgaggcctggttcggcagcgaatacctgctccggatgctggatgcctttggcggccctttctgggacgtcaagggcagcggcggcttccagcatcccgaagatcacaccgacggagtgatcggcacggccgacgaccgtcgcatctccgggatgggcgtcggtggctctgcgaaggcggccggctcgctcgccgccaccgccagggcgatcagagccgccatcgacagcggtgacatcgccgcgggggatgccacggcctgggaggcttgggccaccgaagcggaggatggagcggtggcgttctacgagcacgccgacacgcaccgcggtgatccgctcggcgggtactcgaccacgcgcggcggcatcgacaactcccttctgtttgccgaagtgcagctctacctcctgacgggagatgtggcgtatcgcacgtcagccgaagcgacgatcgccgcgacgccgttcacgatcctgtccaatacgaactactgggacatggggccgctgtcgatggcggagctgtatcccgctgcgacggcgaccggcaagacgaatatccagcgctacctcaagaagcaactggactacgtgctttcttcgaccgatgacaccccttacggtgtcatcaaccagttcaagaacttcggtgtcaacgagccgcacgtgtcctacatggccgacgtgcttcgctactgggagctgttcggcgacgagcgtgcgctgcgagctgtgcagaagggaatgtactgggtgttcggcaacaacccctggggaacgagctgggtctcgggtgtgggcgagaagcacaccatgttcctgcacacgcggctcgacgagcaggcgcagacccagggcggaacgggaatcatcctgcctggcgcgctcgtgtcgggaccgaacgcgaaggacccgctcgatccgaccagcgccagcccctggtacgaagaccgctccggtttcgccgatgtcggccagcagtggcggtacaacgagtacagcgttagcatccaagccggacttttctcggccatgttcgggctcaccgctgccggtgatgcgccgtggtccagcgggacacctccgacggcgctgaccatcggatccccgcagatcggtcagtacgtcactgacgaggtgactgtcttcgcccagagcggctcatcgctcacggcgcacgcgctcggaccggactggacgccgatgacatcgtcagccggagtctcgaccggagtggtcgatgtgagcaacctcgcgccctacacgaacgcccgcatcgatgtgcgcggcacgcaggcgagcggagcgcacagctacagctccacccactacacggtcgcgccgcctctgccgacccccgacaccccgctgctctacgacggtttcgggcgcgacggtctgttcggcgtgcaggggtacacgtgggcgaactggtacaacaaccatgccggcgtgggtcaggtgaccaacagcaccgtggatggacgcaccgtgggccggttcttccacaatcccgccacggcgatgtcgcaggcgaagttccagccctggcatcactcggtggatgcggagggataccgctacttgtcggtgacgatgcgcagcccgtcaccgaatctccgcctgcggatcgaggtgtcggacggcgactcgaatcaccgcgtgaccgggacgacgccgatcgcgatctcgaacgactggaccacgtatgatttcgacctcgcggcgttccctggcctcgatcggtcgcaggccaagctcgtgttctggttgcagcagaccgccgacaccgacggcgagctgtttgtcgattccgtggagttcacgaacgatgcctccggtagcgcgccggggctctcggatgtcagccacacggccggcaccctgacaccgtctactccggtcacggtccaggcgacctacactgacgccgacggagccgctccatacgcggtcgagctcgtcgtcgacggggtgatccaccggatgtctcccgtcgaccccggtgataccgacatgaccgacggcgcgcagtactccgttgccgtgtcactcgtgaagggcgagcacagctacttcgtgcgcacgaccgacacgacctctgcggtggtcaggacaccggtggtgtccggcgtcgccgtcggctga

SEQ ID NO: 20 - protein, 953 aa, Artificial Sequence
  Synthetic Construct
MKKPLGKIVASTALLISVAFSSSIASAHHHHHHPRATIEEVTVSQAGYSAGGYKVGFAVADGAVPGSTSCRILQGETVVLPSCTLLDRGTTWGARVYQVDFSTFDDVGADFALEIGGVRSPRFAVEGNVWSGYLDEMTAFYRLQRSGVDTADAYPAGYSSIAPSDKVFHAAGHLDDAASEDGTQHYDLTGGWYDAGDYGIYGGNQWVAGNIAISYLRYGDTPEVAFDGDSNDVPDLVDEAWFGSEYLLRMLDAFGGPFWDVKGSGGFQHPEDHTDGVIGTADDRRISGMGVGGSAKAAGSLAATARAIRAAIDSGDIAAGDATAWEAWATEAEDGAVAFYEHADTHRGDPLGGYSTTRGGIDNSLLFAEVQLYLLTGDVAYRTSAEATIAATPFTILSNTNYWDMGPLSMAELYPAATATGKTNIQRYLKKQLDYVLSSTDDTPYGVINQFKNFGVNEPHVSYMADVLRYWELFGDERALRAVQKGMYWVFGNNPWGTSWVSGVGEKHTMFLHTRLDEQAQTQGGTGIILPGALVSGPNAKDPLDPTSASPWYEDRSGFADVGQQWRYNEYSVSIQAGLFSAMFGLTAAGDAPWSSGTPPTALTIGSPQIGQYVTDEVTVFAQSGSSLTAHALGPDWTPMTSSAGVSTGVVDVSNLAPYTNARIDVRGTQASGAHSYSSTHYTVAPPLPTPDTPLLYDGFGRDGLFGVQGYTWANWYNNHAGVGQVTNSTVDGRTVGRFFHNPATAMSQAKFQPWHHSVDAEGYRYLSVTMRSPSPNLRLRIEVSDGDSNHRVTGTTPIAISNDWTTYDFDLAAFPGLDRSQAKLVFWLQQTADTDGELFVDSVEFTNDASGSAPGLSDVSHTAGTLTPSTPVTVQATYTDADGAAPYAVELVVDGVIHRMSPVDPGDTDMTDGAQYSVAVSLVKGEHSYFVRTTDTTSAVVRTPVVSGVAVG

SEQ ID NO: 21 - DNA, 46 bp, Artificial Sequence
  Primer D88F
tcaccatcatcctaggatcgcaggcgtggttcaaagcgtgaatgtc

SEQ ID NO: 22 - DNA, 46 bp, Artificial Sequence
  Primer D89R
ttattgattaacgcgtttacggaactggaacaagctgaatgaaatc

SEQ ID NO: 23 - DNA, 41 bp, Artificial Sequence
  Primer D124F
tcaccatcatcctagggcgacgatcgaacgcgtcgccgtca

SEQ ID NO: 24 - DNA, 41 bp, Artificial Sequence
  Primer D125R
ttattgattaacgcgttcatccgacgaccactccggtcacg

SEQ ID NO: 25 - DNA, 41 bp, Artificial Sequence
  Primer D126F
tcaccatcatcctagggcgacgatcacacaggtcgcggtga

SEQ ID NO: 26 - DNA, 41 bp, Artificial Sequence
  Primer D127R
ttattgattaacgcgtctactgaacgaccacccccgtcgtg

SEQ ID NO: 27 - DNA, 41 bp, Artificial
  Primer D128F
tcaccatcatcctagggccaccatcgaggaagtcacggtga

SEQ ID NO: 28 - DNA, 41 bp, Artificial Sequence
  Primer D129R
ttattgattaacgcgttcagccgacggcgacgccggacacc

SEQ ID NO: 29 - protein, 27 aa, Artificial Sequence
  Signal sequence
MKKPLGKIVASTALLISVAFSSSIASA

SEQ ID NO: 30 - protein, 8 aa, Artificial Sequence
  His-tag
HHHHHHPR

SEQ ID NO: 31 - DNA, 41 bp, Artificial Sequence
  Primer D117F
tcaccatcatcctagggcggaggcgtccgacatgttcgacg

SEQ ID NO: 32 - DNA, 41 bp, Artificial Sequence
  Primer D118R
ttattgattaacgcgtttacggctgctgcgcgccggtcagg

SEQ ID NO: 33 - DNA, 52 bp, Artificial Sequence
  Primer D158F
gcttttagttcatcgatcgcatcggctatcgcaggcgtggttcaaagcgtga

SEQ ID NO: 34 - DNA, 44 bp, Artificial Sequence
  Primer D159R
ttattgattaacgcgtttacggaactggaacaagctgaatgaaa

SEQ ID NO: 35 - DNA, 52 bp, Artificial Sequence
  Primer D168F
gcttttagttcatcgatcgcatcggctgcgacgatcgaacgcgtcgccgtca

SEQ ID NO: 36 - DNA, 41 bp, Artificial Sequence; identical to SEQ ID NO: 24
  Primer D169R

SEQ ID NO: 37 - DNA, 52 bp, Artificial Sequence
  Primer D170F
gcttttagttcatcgatcgcatcggctgcgacgatcacacaggtcgcggtga

SEQ ID NO: 38 - DNA, 41 bp, Artificial Sequence; identical to SEQ ID NO: 26
  Primer D170R

SEQ ID NO: 39 - DNA, 52 bp, Artificial Sequence
  Primer D171F
gcttttagttcatcgatcgcatcggctgccaccatcgaggaagtcacggtga

SEQ ID NO: 40 - DNA, 41 bp, Artificial Sequence; identical to SEQ ID NO: 28
  Primer D172R

SEQ ID NO: 41 - DNA, 52 bp, Artificial Sequence
  Primer D160F
gcttttagttcatcgatcgcatcggctgcggaggcgtccgacatgttcgacg

SEQ ID NO: 42 - DNA, 41 bp, Artificial Sequence; identical to SEQ ID NO: 32
  Primer D161R

SEQ ID NO: 43 - DNA, 36 bp, Artificial Sequence
  Primer F-C3AQX
ggtgaagcgtacgcgtgcggaggcgtccgacatgtt

SEQ ID NO: 44 - DNA, 36 bp, Artificial Sequence
  Primer R-C3AQX
agatctcgagaagcttttacggctgctgcgcgccgg

SEQ ID NO: 45 - DNA, 3437 bp, Paenibacillus sp.
  CDS (116)..(3337)
  sig_peptide (116)..(208)
  mat_peptide (209)..(3337)
caaaacgctcgaaaatggataccatttctcgatattggacggttttatccttgtgggaggttttttatacttgataattgtaagcgcattcaaattatgattgggagggaatataatgttgaagcaagggatgaaaagatggacaagcgtttgtctggctatcatcatgttcagtctgacttttttgaatgcgggaactgtaccgagagcggaggcgtccgacatgttcgacgagcttagagaaaagtatgcaaccatgctgaccggagggacggcgtatagtctgtccgatccggatatcgccgcgcgggtggcgtcgattacgaccaacgcgcagacactgtggacctccatgaagaaggatgcgaacagagtgcggttatgggacaacgcgccgctcggcaacgattcggcgagcattacgaccagctaccggcagcttgcggccatggcgctcgcttaccgcacgtatggctccagcctgatgggtgatcccgacttgcgcgatgacattatcgacgggctggactggataaatacgttccagcacggcttctgcgaaggctgcagcatgtatcagaactggtggcattggcagatcggcggcccgattgcgcttaatgaagtcatcgcgcttatgtacgacgagctgacgcagacgcaaatcgacagctacatagcggcgatcaactatgcgcagccgagcgtgaacatgaccggggcaaacaggctttgggaaagccaggttatcgctttggcgggcatcaacggcaagaacggcgacaagatcgcgcatgcccgggacgggctgagcgcgctgctgacgtacgttgtgcagggggacggcttttacgaggacggctcgttcgtccagcattcctactactcctacaacggcgggtacggcctggatttgctgaagggcattgccgacttgacttatttgctgcacgactcgaactgggaagtcgtcgatccgaacaagcagaacattttcaactgggtatacgattccttcgagccgtttatttataacggaaatctgatggacatggtgcgggggcgggaaatatcgcggcatgcgaggcaaagcaacgtcgttggcgtcgaggccgtcgccgccattctgcgcttgtcccatgtagctccgcctgcggacgcggcagccttcaagagcatggtcaagcattggctccaggaaggcgggggaagccaattcctgcagcaagcttcgattacgcatatattgagcgcgcaggacgttctgaacgattccggcatcgtccctagaggcgaactggaagcttaccgccagtttgccggcatggaccgggcgctgcagctgcggcagggctacggcttcggcatcagcatgttttccagccggatcggcggccatgaagccattaacgcggagaacaacaaaggctggcataccggcgcgggcatgacttacttgtacaacaacgacttgagccagttcaacgatcatttctggccgactgtcaacagctaccggctgcccggtacgacggtgctgcgcgacacgccgcaagcggccaatacgcgaggcgacagatcctgggcgggcggtacggatatgctgggactatacggcataaccggtatggaatatcatgcaatcggcaaaagcttgaccgccaagaagtcctggttcatgtttgacgacgaaatcgtcgctctcggagcggacataacaagcggcgacggcgttgccgtcgaaacgatcgtcgaaaaccgcaagctgaacggtgcgggagacaattcgcttacggtgaacggcacggccaagccggcaacgctcggctggtcggagacgatgggcacgacaagctacgcacatcttgggggcagcgttgccgactcggatatcggctactacttcccggatggcggagcgacgctgcatgcccttcgcgaagcgcgcacaggcaattggcggcaaataaactcggcccagggctcgcccaatgcgccgcatacgcgaaactatttgaccatgtggctggagcatggcgtgaatccgtcgaatggggcttactcgtatgtgctgctgccgaacaagacgagcgcagcgacggcaagctatgctgcttcgcccgatattacgattattgaaaactcttcctccgcccaggcggtgaaggaaaacggcctcaatatgatcggcgtgaacttctggaataatgagcgaaagacggcagggggcattacttcgaatgccaaagcgtcggtcatgacgcgggaaacggcaagcgagttgaatgtatcggtgtccgatccgacgcagagcaatgtcggcatgatctatatcgagatcgacaaaagcgcaacggggcttattgcgaaggacgatgccgttacggtgctgcaatacagtccaacgatcaaattcaaggttgatgtgaacaaggcgcgcggcaagtcattcaaggcggcattcagcctgaccggcgcgcagcagccgaatcctgcgccaatcccgattcctaatccgtacgaggcggagctgctgccgatttccgcaacgacgaaaacgccgacgctcagcaatgacagcaacgcgagcggcggcaagaagctcggcctcaatagcagcgtcgtcggcgattacacggaattcagtctcgatgtgacccagccgggcacctacgatatcgcggccaaaataatgaaggtaagcaataacggcatttaccagttttccatcaacggcgagcctgtcggcgaccccgtcgatatgtattggaacacctccgaatcaacgaagagcttctcgccgggctcctacacattcagcgaaccgggcagctatctgctccgggtgacggtgaccggcaagcatccgagctcgtcgggctacaagctgatgctggatcattttacgctggaggagattcccgtttcgctgcccaatccgtatgaagcggaaacactgccgatccatcatcgcacccagacggtgacgatctacaacgactcgaatacgagcggaggacagcggctgggtctcaatcacaaggttgtcggcgattatacggagtttatactcgacgtgccgcaagcgggcacctacgatatcacggcccgcgtcttgaagttcagcgacaacggcatttatcaattctcgatcgacggcaatcccgtgggcgcgccgattgatacgtattggaatacggcgggttatatccgggatttcacgccgggctcctatacgttcagcgagccggggagctacctgctccgcctgacggcaacagggaaaaatccgagcgcgtcgggtctgaagattatgcttgattacatctggctcgactgacgcgggccatgcttcggaggggcgaagcccggcagcccataatagatcatcatattcttagcattgatcatggacatcgagcttgacggtctatata

SEQ ID NO: 46 - protein, 1074 aa, Paenibacillus sp.
MLKQGMKRWTSVCLAIIMFSLTFLNAGTVPRAEASDMFDELREKYATMLTGGTAYSLSDPDIAARVASITTNAQTLWTSMKKDANRVRLWDNAPLGNDSASITTSYRQLAAMALAYRTYGSSLMGDPDLRDDIIDGLDWINTFQHGFCEGCSMYQNWWHWQIGGPIALNEVIALMYDELTQTQIDSYIAAINYAQPSVNMTGANRLWESQVIALAGINGKNGDKIAHARDGLSALLTYVVQGDGFYEDGSFVQHSYYSYNGGYGLDLLKGIADLTYLLHDSNWEVVDPNKQNIFNWVYDSFEPFIYNGNLMDMVRGREISRHARQSNVVGVEAVAAILRLSHVAPPADAAAFKSMVKHWLQEGGGSQFLQQASITHILSAQDVLNDSGIVPRGELEAYRQFAGMDRALQLRQGYGFGISMFSSRIGGHEAINAENNKGWHTGAGMTYLYNNDLSQFNDHFWPTVNSYRLPGTTVLRDTPQAANTRGDRSWAGGTDMLGLYGITGMEYHAIGKSLTAKKSWFMFDDEIVALGADITSGDGVAVETIVENRKLNGAGDNSLTVNGTAKPATLGWSETMGTTSYAHLGGSVADSDIGYYFPDGGATLHALREARTGNWRQINSAQGSPNAPHTRNYLTMWLEHGVNPSNGAYSYVLLPNKTSAATASYAASPDITIIENSSSAQAVKENGLNMIGVNFWNNERKTAGGITSNAKASVMTRETASELNVSVSDPTQSNVGMIYIEIDKSATGLIAKDDAVTVLQYSPTIKFKVDVNKARGKSFKAAFSLTGAQQPNPAPIPIPNPYEAELLPISATTKTPTLSNDSNASGGKKLGLNSSVVGDYTEFSLDVTQPGTYDIAAKIMKVSNNGIYQFSINGEPVGDPVDMYWNTSESTKSFSPGSYTFSEPGSYLLRVTVTGKHPSSSGYKLMLDHFTLEEIPVSLPNPYEAETLPIHHRTQTVTIYNDSNTSGGQRLGLNHKVVGDYTEFILDVPQAGTYDITARVLKFSDNGIYQFSIDGNPVGAPIDTYWNTAGYIRDFTPGSYTFSEPGSYLLRLTATGKNPSASGLKIMLDYIWLD

SEQ ID NO: 47 - DNA, 3132 bp, Paenibacillus sp.
  CDS (1)..(3129)
  sig_peptide (1)..(108)
  mat_peptide (109)..(3129)
atggaacatgtaataaaacgttggttacgcaaaatgctgctgcttggattggccctgctaatgatgttgaatctcggatggctggcaccaatccctactgcttcagcggcagggaccgtcagcaaaatttccgttagccaagccggctatggggtgaacgcttacaaggtggcattcattatggcaaccggagcattatccgatcttagctatgaggtgcgtaaaggctcaagcgtcatcacgacagggacactgaaggatgaaggcttggtctggggcgcacgggtgtattcggctgattttactgcgctccagcaggagggcgccggatacatgatttacagcaatggggcgacttcgtaccctttcgccattcagtcgaatatgtgggactcgtacaaggacgagatggtcgcgttctatcggctgcttcgcacaacggatacgagagtcgcgtacccggatggattcagcagcgtggcgccttcaagcaaaatttttcatggggattccttcctcgatgatgcggtttccccagatggaaagacgcattatgacctgtcaggcggttggttcgatgcaggcgattacgggaaatatgcaggaaaccaatgggtccagggaaatatcgcgatctcgtaccttcggcatgcggattcaccggaattaagctttgacaacgatcataatggcattccggatctggtggatgaagcgatatttggcagccaatacttggtgaagtttgctaatcagctcggcggcgcgattcacaatatattgagaaagggcggcttcgtgctcccggataaggtcacggacaacatccccggcaatgcggatgatcgtccgttggattcgattatcgctgtcggcggctccggcaaatcggccggttcgcttgcggcaacggcacgtgccattcatacggcgattagcaaaggccaagtagcgccgggggctgtcgcacagcttgaagcgcttgctgatgagtttaaggcagctgcgcttgtattttatcaatacgctctcgatcatccgaacggggatgaggggtcctataagactgacgggataccgaatacgttgctgtttgccgaagtccagctgtatctgctgacgaaggaagcggcgtataaagatgcggcccaagcccgaattgccacactcaagacagagcaggagagatccacgaactattgggatatgcgtccaatcagcttggcggagttctatccggttgcggatgcagccacacaagcgaagattcacagtcttctgaaataccaggcggagtatttcatgtcgcttgctgacgatacgccttacggcgtattcaatcaattcggcaatttcggtgtgaatgagccgcatgcttcgtatgtagccgatttattgaggtactatgagctgttccaagacccggctgctctccgcgccgtgcagaagggattgtattggatctttggcaataatccttggacgaccagctgggtgtcgggcatcggttccgaatatgttaaatatttgcatactcgattcgatgaacagtcctacagccagacgaatccgggtgtggtgcttccgggagccatggtaagcgggccgaacatcaaggacccgcataataagctgagcgctagtccttggtatgaggacagaccgctctggcaggatgatacacagcagtggagatataatgagttcagcgtcagcattcagacaggtttgttctacacaattatgggccttgcagctatggatgggcttgcctctacgggcggttccgaatccatacgactgcctatcacgacgcctatcattggtgattttgtaaccggggaagttacggttatggctcagcctacagaggagattgtctccattgagccgccttttgtcccaatggcaggagcagatggcatttattctacgtctgtggatacaagcagcgatctaccctatgcggagaaacgtgtccaggtgcgaggaacagacagtgctggtagaaggacctacaccaatacgcacttcacggttgccccgccgctgccggatccttctcacccgctgctctatgacagcttcagccagcagggcatttggggaagccagaggatggattgggtcaactggtggaatcaggacggaggtacggctaggtatcagcgggcattggcggaggaccgaggcgtggggaaatttacacagacgccggcttccagcaagtcgcgagctaaattccagccatggaaatacgaggcgaaccttgccggctatcgttacttgaaggtgacgatgaaaaaccctggattttcggattcccgcattcaaatcgtcgccaacgacggcgtgaaagggtataacctgagcggtgggaatttggcggttggatcggaatggacgacatatcaattcgacatggatcagttcccgacgatggataaatccaagctgatgttcgaaatttggctcagctccactacgggacaatacggggaaatttggctggatgaaatgatagctgtgaatacggagagcggcaccgcaccggaattgaaagatgcgggaacggatgcgctggccggcgatgtggatacgctttacaactttagtgccaagtattcggatgccgataatgacaaaccgtttgccatgcaggtcgtgattgacggtgtgattcgttcgatggttgagacggacccgtcggatctcgattatcgggatggcaaagagtattcgtactccacgaagctgccaaagggacagcattcgttttacttccggacgactgatacgaagaccccggcggtacggacagctaaggtcgacggaccagcggtctaccagacttttacggatacggagaagccatcggctcctgcaagcctccaagccacggtcgctaagaacgccgacattcaactggtatgggagaagtcgaccgataatgtaggcgtgaagcgctacaaggtttaccgggatggagaggacattggcggggccgaagctcctggttataccgacaccaagctgaagccgtctactacttacatttataccgtgaaggctatcgatgctgcgggtaatgcatcggatgacagtgctccggttagcgcaacaacaccctaa

SEQ ID NO: 48 - protein, 1043 aa, Paenibacillus sp.
MEHVIKRWLRKMLLLGLALLMMLNLGWLAPIPTASAAGTVSKISVSQAGYGVNAYKVAFIMATGALSDLSYEVRKGSSVITTGTLKDEGLVWGARVYSADFTALQQEGAGYMIYSNGATSYPFAIQSNMWDSYKDEMVAFYRLLRTTDTRVAYPDGFSSVAPSSKIFHGDSFLDDAVSPDGKTHYDLSGGWFDAGDYGKYAGNQWVQGNIAISYLRHADSPELSFDNDHNGIPDLVDEAIFGSQYLVKFANQLGGAIHNILRKGGFVLPDKVTDNIPGNADDRPLDSIIAVGGSGKSAGSLAATARAIHTAISKGQVAPGAVAQLEALADEFKAAALVFYQYALDHPNGDEGSYKTDGIPNTLLFAEVQLYLLTKEAAYKDAAQARIATLKTEQERSTNYWDMRPISLAEFYPVADAATQAKIHSLLKYQAEYFMSLADDTPYGVFNQFGNFGVNEPHASYVADLLRYYELFQDPAALRAVQKGLYWIFGNNPWTTSWVSGIGSEYVKYLHTRFDEQSYSQTNPGVVLPGAMVSGPNIKDPHNKLSASPWYEDRPLWQDDTQQWRYNEFSVSIQTGLFYTIMGLAAMDGLASTGGSESIRLPITTPIIGDFVTGEVTVMAQPTEEIVSIEPPFVPMAGADGIYSTSVDTSSDLPYAEKRVQVRGTDSAGRRTYTNTHFTVAPPLPDPSHPLLYDSFSQQGIWGSQRMDWVNWWNQDGGTARYQRALAEDRGVGKFTQTPASSKSRAKFQPWKYEANLAGYRYLKVTMKNPGFSDSRIQIVANDGVKGYNLSGGNLAVGSEWTTYQFDMDQFPTMDKSKLMFEIWLSSTTGQYGEIWLDEMIAVNTESGTAPELKDAGTDALAGDVDTLYNFSAKYSDADNDKPFAMQVVIDGVIRSMVETDPSDLDYRDGKEYSYSTKLPKGQHSFYFRTTDTKTPAVRTAKVDGPAVYQTFTDTEKPSAPASLQATVAKNADIQLVWEKSTDNVGVKRYKVYRDGEDIGGAEAPGYTDTKLKPSTTYIYTVKAIDAAGNASDDSAPVSATTP

SEQ ID NO: 49 - DNA, 3129 bp, Artificial Sequence
  Synthetic construct
  CDS (1)..(3126)
  sig_peptide (1)..(81)
  mat_peptide (82)..(3126)
atgaagaaaccgttggggaaaattgtcgcaagcaccgcactactcatttctgttgcttttagttcatcgatagcatcagcacatcatcatcaccatcatcctagggcagggaccgtcagcaaaatttccgttagccaagccggctatggggtgaacgcttacaaggtggcattcattatggcaaccggagcattatccgatcttagctatgaggtgcgtaaaggctcaagcgtcatcacgacagggacactgaaggatgaaggcttggtctggggcgcacgggtgtattcggctgattttactgcgctccagcaggagggcgccggatacatgatttacagcaatggggcgacttcgtaccctttcgccattcagtcgaatatgtgggactcgtacaaggacgagatggtcgcgttctatcggctgcttcgcacaacggatacgagagtcgcgtacccggatggattcagcagcgtggcgccttcaagcaaaatttttcatggggattccttcctcgatgatgcggtttccccagatggaaagacgcattatgacctgtcaggcggttggttcgatgcaggcgattacgggaaatatgcaggaaaccaatgggtccagggaaatatcgcgatctcgtaccttcggcatgcggattcaccggaattaagctttgacaacgatcataatggcattccggatctggtggatgaagcgatatttggcagccaatacttggtgaagtttgctaatcagctcggcggcgcgattcacaatatattgagaaagggcggcttcgtgctcccggataaggtcacggacaacatccccggcaatgcggatgatcgtccgttggattcgattatcgctgtcggcggctccggcaaatcggccggttcgcttgcggcaacggcacgtgccattcatacggcgattagcaaaggccaagtagcgccgggggctgtcgcacagcttgaagcgcttgctgatgagtttaaggcagctgcgcttgtattttatcaatacgctctcgatcatccgaacggggatgaggggtcctataagactgacgggataccgaatacgttgctgtttgccgaagtccagctgtatctgctgacgaaggaagcggcgtataaagatgcggcccaagcccgaattgccacactcaagacagagcaggagagatccacgaactattgggatatgcgtccaatcagcttggcggagttctatccggttgcggatgcagccacacaagcgaagattcacagtcttctgaaataccaggcggagtatttcatgtcgcttgctgacgatacgccttacggcgtattcaatcaattcggcaatttcggtgtgaatgagccgcatgcttcgtatgtagccgatttattgaggtactatgagctgttccaagacccggctgctctccgcgccgtgcagaagggattgtattggatctttggcaataatccttggacgaccagctgggtgtcgggcatcggttccgaatatgttaaatatttgcatactcgattcgatgaacagtcctacagccagacgaatccgggtgtggtgcttccgggagccatggtaagcgggccgaacatcaaggacccgcataataagctgagcgctagtccttggtatgaggacagaccgctctggcaggatgatacacagcagtggagatataatgagttcagcgtcagcattcagacaggtttgttctacacaattatgggccttgcagctatggatgggcttgcctctacgggcggttccgaatccatacgactgcctatcacgacgcctatcattggtgattttgtaaccggggaagttacggttatggctcagcctacagaggagattgtctccattgagccgccttttgtcccaatggcaggagcagatggcatttattctacgtctgtggatacaagcagcgatctaccctatgcggagaaacgtgtccaggtgcgaggaacagacagtgctggtagaaggacctacaccaatacgcacttcacggttgccccgccgctgccggatccttctcacccgctgctctatgacagcttcagccagcagggcatttggggaagccagaggatggattgggtcaactggtggaatcaggacggaggtacggctaggtatcagcgggcattggcggaggaccgaggcgtggggaaatttacacagacgccggcttccagcaagtcgcgagctaaattccagccatggaaatacgaggcgaaccttgccggctatcgttacttgaaggtgacgatgaaaaaccctggattttcggattcccgcattcaaatcgtcgccaacgacggcgtgaaagggtataacctgagcggtgggaatttggcggttggatcggaatggacgacatatcaattcgacatggatcagttcccgacgatggataaatccaagctgatgttcgaaatttggctcagctccactacgggacaatacggggaaatttggctggatgaaatgatagctgtgaatacggagagcggcaccgcaccggaattgaaagatgcgggaacggatgcgctggccggcgatgtggatacgctttacaactttagtgccaagtattcggatgccgataatgacaaaccgtttgccatgcaggtcgtgattgacggtgtgattcgttcgatggttgagacggacccgtcggatctcgattatcgggatggcaaagagtattcgtactccacgaagctgccaaagggacagcattcgttttacttccggacgactgatacgaagaccccggcggtacggacagctaaggtcgacggaccagcggtctaccagacttttacggatacggagaagccatcggctcctgcaagcctccaagccacggtcgctaagaacgccgacattcaactggtatgggagaagtcgaccgataatgtaggcgtgaagcgctacaaggtttaccgggatggagaggacattggcggggccgaagctcctggttataccgacaccaagctgaagccgtctactacttacatttataccgtgaaggctatcgatgctgcgggtaatgcatcggatgacagtgctccggttagcgcaacaacaccctaa

SEQ ID NO: 50 - protein, 1042 aa, Artificial Sequence
  Synthetic Construct
MKKPLGKIVASTALLISVAFSSSIASAHHHHHHPRAGTVSKISVSQAGYGVNAYKVAFIMATGALSDLSYEVRKGSSVITTGTLKDEGLVWGARVYSADFTALQQEGAGYMIYSNGATSYPFAIQSNMWDSYKDEMVAFYRLLRTTDTRVAYPDGFSSVAPSSKIFHGDSFLDDAVSPDGKTHYDLSGGWFDAGDYGKYAGNQWVQGNIAISYLRHADSPELSFDNDHNGIPDLVDEAIFGSQYLVKFANQLGGAIHNILRKGGFVLPDKVTDNIPGNADDRPLDSIIAVGGSGKSAGSLAATARAIHTAISKGQVAPGAVAQLEALADEFKAAALVFYQYALDHPNGDEGSYKTDGIPNTLLFAEVQLYLLTKEAAYKDAAQARIATLKTEQERSTNYWDMRPISLAEFYPVADAATQAKIHSLLKYQAEYFMSLADDTPYGVFNQFGNFGVNEPHASYVADLLRYYELFQDPAALRAVQKGLYWIFGNNPWTTSWVSGIGSEYVKYLHTRFDEQSYSQTNPGVVLPGAMVSGPNIKDPHNKLSASPWYEDRPLWQDDTQQWRYNEFSVSIQTGLFYTIMGLAAMDGLASTGGSESIRLPITTPIIGDFVTGEVTVMAQPTEEIVSIEPPFVPMAGADGIYSTSVDTSSDLPYAEKRVQVRGTDSAGRRTYTNTHFTVAPPLPDPSHPLLYDSFSQQGIWGSQRMDWVNWWNQDGGTARYQRALAEDRGVGKFTQTPASSKSRAKFQPWKYEANLAGYRYLKVTMKNPGFSDSRIQIVANDGVKGYNLSGGNLAVGSEWTTYQFDMDQFPTMDKSKLMFEIWLSSTTGQYGEIWLDEMIAVNTESGTAPELKDAGTDALAGDVDTLYNFSAKYSDADNDKPFAMQVVIDGVIRSMVETDPSDLDYRDGKEYSYSTKLPKGQHSFYFRTTDTKTPAVRTAKVDGPAVYQTFTDTEKPSAPASLQATVAKNADIQLVWEKSTDNVGVKRYKVYRDGEDIGGAEAPGYTDTKLKPSTTYIYTVKAIDAAGNASDDSAPVSATTP

SEQ ID NO: 51 - DNA, 2856 bp, Paenibacillus sp
  CDS (1)..(2853)
  sig_peptide (1)..(108)
  mat_peptide (109)..(2853)
atggaacatgtaataaaacgttggttacgcaaaatgctgctgcttggattggccctgctaatgatgttgaatctcggatggctggcaccaatccctactgcttcagcggcagggaccgtcagcaaaatttccgttagccaagccggctatggggtgaacgcttacaaggtggcattcattatggcaaccggagcattatccgatcttagctatgaggtgcgtaaaggctcaagcgtcatcacgacagggacactgaaggatgaaggcttggtctggggcgcacgggtgtattcggctgattttactgcgctccagcaggagggcgccggatacatgatttacagcaatggggcgacttcgtaccctttcgccattcagtcgaatatgtgggactcgtacaaggacgagatggtcgcgttctatcggctgcttcgcacaacggatacgagagtcgcgtacccggatggattcagcagcgtggcgccttcaagcaaaatttttcatggggattccttcctcgatgatgcggtttccccagatggaaagacgcattatgacctgtcaggcggttggttcgatgcaggcgattacgggaaatatgcaggaaaccaatgggtccagggaaatatcgcgatctcgtaccttcggcatgcggattcaccggaattaagctttgacaacgatcataatggcattccggatctggtggatgaagcgatatttggcagccaatacttggtgaagtttgctaatcagctcggcggcgcgattcacaatatattgagaaagggcggcttcgtgctcccggataaggtcacggacaacatccccggcaatgcggatgatcgtccgttggattcgattatcgctgtcggcggctccggcaaatcggccggttcgcttgcggcaacggcacgtgccattcatacggcgattagcaaaggccaagtagcgccgggggctgtcgcacagcttgaagcgcttgctgatgagtttaaggcagctgcgcttgtattttatcaatacgctctcgatcatccgaacggggatgaggggtcctataagactgacgggataccgaatacgttgctgtttgccgaagtccagctgtatctgctgacgaaggaagcggcgtataaagatgcggcccaagcccgaattgccacactcaagacagagcaggagagatccacgaactattgggatatgcgtccaatcagcttggcggagttctatccggttgcggatgcagccacacaagcgaagattcacagtcttctgaaataccaggcggagtatttcatgtcgcttgctgacgatacgccttacggcgtattcaatcaattcggcaatttcggtgtgaatgagccgcatgcttcgtatgtagccgatttattgaggtactatgagctgttccaagacccggctgctctccgcgccgtgcagaagggattgtattggatctttggcaataatccttggacgaccagctgggtgtcgggcatcggttccgaatatgttaaatatttgcatactcgattcgatgaacagtcctacagccagacgaatccgggtgtggtgcttccgggagccatggtaagcgggccgaacatcaaggacccgcataataagctgagcgctagtccttggtatgaggacagaccgctctggcaggatgatacacagcagtggagatataatgagttcagcgtcagcattcagacaggtttgttctacacaattatgggccttgcagctatggatgggcttgcctctacgggcggttccgaatccatacgactgcctatcacgacgcctatcattggtgattttgtaaccggggaagttacggttatggctcagcctacagaggagattgtctccattgagccgccttttgtcccaatggcaggagcagatggcatttattctacgtctgtggatacaagcagcgatctaccctatgcggagaaacgtgtccaggtgcgaggaacagacagtgctggtagaaggacctacaccaatacgcacttcacggttgccccgccgctgccggatccttctcacccgctgctctatgacagcttcagccagcagggcatttggggaagccagaggatggattgggtcaactggtggaatcaggacggaggtacggctaggtatcagcgggcattggcggaggaccgaggcgtggggaaatttacacagacgccggcttccagcaagtcgcgagctaaattccagccatggaaatacgaggcgaaccttgccggctatcgttacttgaaggtgacgatgaaaaaccctggattttcggattcccgcattcaaatcgtcgccaacgacggcgtgaaagggtataacctgagcggtgggaatttggcggttggatcggaatggacgacatatcaattcgacatggatcagttcccgacgatggataaatccaagctgatgttcgaaatttggctcagctccactacgggacaatacggggaaatttggctggatgaaatgatagctgtgaatacggagagcggcaccgcaccggaattgaaagatgcgggaacggatgcgctggccggcgatgtggatacgctttacaactttagtgccaagtattcggatgccgataatgacaaaccgtttgccatgcaggtcgtgattgacggtgtgattcgttcgatggttgagacggacccgtcggatctcgattatcgggatggcaaagagtattcgtactccacgaagctgccaaagggacagcattcgttttacttccggacgactgatacgaagaccccggcggtacggacagctaaggtcgacggaccagcggtctaccagacttaa

SEQ ID NO: 52 - protein, 951 aa, Paenibacillus sp
MEHVIKRWLRKMLLLGLALLMMLNLGWLAPIPTASAAGTVSKISVSQAGYGVNAYKVAFIMATGALSDLSYEVRKGSSVITTGTLKDEGLVWGARVYSADFTALQQEGAGYMIYSNGATSYPFAIQSNMWDSYKDEMVAFYRLLRTTDTRVAYPDGFSSVAPSSKIFHGDSFLDDAVSPDGKTHYDLSGGWFDAGDYGKYAGNQWVQGNIAISYLRHADSPELSFDNDHNGIPDLVDEAIFGSQYLVKFANQLGGAIHNILRKGGFVLPDKVTDNIPGNADDRPLDSIIAVGGSGKSAGSLAATARAIHTAISKGQVAPGAVAQLEALADEFKAAALVFYQYALDHPNGDEGSYKTDGIPNTLLFAEVQLYLLTKEAAYKDAAQARIATLKTEQERSTNYWDMRPISLAEFYPVADAATQAKIHSLLKYQAEYFMSLADDTPYGVFNQFGNFGVNEPHASYVADLLRYYELFQDPAALRAVQKGLYWIFGNNPWTTSWVSGIGSEYVKYLHTRFDEQSYSQTNPGVVLPGAMVSGPNIKDPHNKLSASPWYEDRPLWQDDTQQWRYNEFSVSIQTGLFYTIMGLAAMDGLASTGGSESIRLPITTPIIGDFVTGEVTVMAQPTEEIVSIEPPFVPMAGADGIYSTSVDTSSDLPYAEKRVQVRGTDSAGRRTYTNTHFTVAPPLPDPSHPLLYDSFSQQGIWGSQRMDWVNWWNQDGGTARYQRALAEDRGVGKFTQTPASSKSRAKFQPWKYEANLAGYRYLKVTMKNPGFSDSRIQIVANDGVKGYNLSGGNLAVGSEWTTYQFDMDQFPTMDKSKLMFEIWLSSTTGQYGEIWLDEMIAVNTESGTAPELKDAGTDALAGDVDTLYNFSAKYSDADNDKPFAMQVVIDGVIRSMVETDPSDLDYRDGKEYSYSTKLPKGQHSFYFRTTDTKTPAVRTAKVDGPAVYQT

SEQ ID NO: 53 - DNA, 2853 bp, Artificial Sequence
  Synthetic construct
  CDS (1)..(2850)
  sig_peptide (1)..(81)
  mat_peptide (82)..(2850)
atgaagaaaccgttggggaaaattgtcgcaagcaccgcactactcatttctgttgcttttagttcatcgatagcatcagcacatcatcatcaccatcatcctagggcagggaccgtcagcaaaatttccgttagccaagccggctatggggtgaacgcttacaaggtggcattcattatggcaaccggagcattatccgatcttagctatgaggtgcgtaaaggctcaagcgtcatcacgacagggacactgaaggatgaaggcttggtctggggcgcacgggtgtattcggctgattttactgcgctccagcaggagggcgccggatacatgatttacagcaatggggcgacttcgtaccctttcgccattcagtcgaatatgtgggactcgtacaaggacgagatggtcgcgttctatcggctgcttcgcacaacggatacgagagtcgcgtacccggatggattcagcagcgtggcgccttcaagcaaaatttttcatggggattccttcctcgatgatgcggtttccccagatggaaagacgcattatgacctgtcaggcggttggttcgatgcaggcgattacgggaaatatgcaggaaaccaatgggtccagggaaatatcgcgatctcgtaccttcggcatgcggattcaccggaattaagctttgacaacgatcataatggcattccggatctggtggatgaagcgatatttggcagccaatacttggtgaagtttgctaatcagctcggcggcgcgattcacaatatattgagaaagggcggcttcgtgctcccggataaggtcacggacaacatccccggcaatgcggatgatcgtccgttggattcgattatcgctgtcggcggctccggcaaatcggccggttcgcttgcggcaacggcacgtgccattcatacggcgattagcaaaggccaagtagcgccgggggctgtcgcacagcttgaagcgcttgctgatgagtttaaggcagctgcgcttgtattttatcaatacgctctcgatcatccgaacggggatgaggggtcctataagactgacgggataccgaatacgttgctgtttgccgaagtccagctgtatctgctgacgaaggaagcggcgtataaagatgcggcccaagcccgaattgccacactcaagacagagcaggagagatccacgaactattgggatatgcgtccaatcagcttggcggagttctatccggttgcggatgcagccacacaagcgaagattcacagtcttctgaaataccaggcggagtatttcatgtcgcttgctgacgatacgccttacggcgtattcaatcaattcggcaatttcggtgtgaatgagccgcatgcttcgtatgtagccgatttattgaggtactatgagctgttccaagacccggctgctctccgcgccgtgcagaagggattgtattggatctttggcaataatccttggacgaccagctgggtgtcgggcatcggttccgaatatgttaaatatttgcatactcgattcgatgaacagtcctacagccagacgaatccgggtgtggtgcttccgggagccatggtaagcgggccgaacatcaaggacccgcataataagctgagcgctagtccttggtatgaggacagaccgctctggcaggatgatacacagcagtggagatataatgagttcagcgtcagcattcagacaggtttgttctacacaattatgggccttgcagctatggatgggcttgcctctacgggcggttccgaatccatacgactgcctatcacgacgcctatcattggtgattttgtaaccggggaagttacggttatggctcagcctacagaggagattgtctccattgagccgccttttgtcccaatggcaggagcagatggcatttattctacgtctgtggatacaagcagcgatctaccctatgcggagaaacgtgtccaggtgcgaggaacagacagtgctggtagaaggacctacaccaatacgcacttcacggttgccccgccgctgccggatccttctcacccgctgctctatgacagcttcagccagcagggcatttggggaagccagaggatggattgggtcaactggtggaatcaggacggaggtacggctaggtatcagcgggcattggcggaggaccgaggcgtggggaaatttacacagacgccggcttccagcaagtcgcgagctaaattccagccatggaaatacgaggcgaaccttgccggctatcgttacttgaaggtgacgatgaaaaaccctggattttcggattcccgcattcaaatcgtcgccaacgacggcgtgaaagggtataacctgagcggtgggaatttggcggttggatcggaatggacgacatatcaattcgacatggatcagttcccgacgatggataaatccaagctgatgttcgaaatttggctcagctccactacgggacaatacggggaaatttggctggatgaaatgatagctgtgaatacggagagcggcaccgcaccggaattgaaagatgcgggaacggatgcgctggccggcgatgtggatacgctttacaactttagtgccaagtattcggatgccgataatgacaaaccgtttgccatgcaggtcgtgattgacggtgtgattcgttcgatggttgagacggacccgtcggatctcgattatcgggatggcaaagagtattcgtactccacgaagctgccaaagggacagcattcgttttacttccggacgactgatacgaagaccccggcggtacggacagctaaggtcgacggaccagcggtctaccagacttaa

SEQ ID NO: 54 - protein, 950 aa, Artificial Sequence
  Synthetic Construct
MKKPLGKIVASTALLISVAFSSSIASAHHHHHHPRAGTVSKISVSQAGYGVNAYKVAFIMATGALSDLSYEVRKGSSVITTGTLKDEGLVWGARVYSADFTALQQEGAGYMIYSNGATSYPFAIQSNMWDSYKDEMVAFYRLLRTTDTRVAYPDGFSSVAPSSKIFHGDSFLDDAVSPDGKTHYDLSGGWFDAGDYGKYAGNQWVQGNIAISYLRHADSPELSFDNDHNGIPDLVDEAIFGSQYLVKFANQLGGAIHNILRKGGFVLPDKVTDNIPGNADDRPLDSIIAVGGSGKSAGSLAATARAIHTAISKGQVAPGAVAQLEALADEFKAAALVFYQYALDHPNGDEGSYKTDGIPNTLLFAEVQLYLLTKEAAYKDAAQARIATLKTEQERSTNYWDMRPISLAEFYPVADAATQAKIHSLLKYQAEYFMSLADDTPYGVFNQFGNFGVNEPHASYVADLLRYYELFQDPAALRAVQKGLYWIFGNNPWTTSWVSGIGSEYVKYLHTRFDEQSYSQTNPGVVLPGAMVSGPNIKDPHNKLSASPWYEDRPLWQDDTQQWRYNEFSVSIQTGLFYTIMGLAAMDGLASTGGSESIRLPITTPIIGDFVTGEVTVMAQPTEEIVSIEPPFVPMAGADGIYSTSVDTSSDLPYAEKRVQVRGTDSAGRRTYTNTHFTVAPPLPDPSHPLLYDSFSQQGIWGSQRMDWVNWWNQDGGTARYQRALAEDRGVGKFTQTPASSKSRAKFQPWKYEANLAGYRYLKVTMKNPGFSDSRIQIVANDGVKGYNLSGGNLAVGSEWTTYQFDMDQFPTMDKSKLMFEIWLSSTTGQYGEIWLDEMIAVNTESGTAPELKDAGTDALAGDVDTLYNFSAKYSDADNDKPFAMQVVIDGVIRSMVETDPSDLDYRDGKEYSYSTKLPKGQHSFYFRTTDTKTPAVRTAKVDGPAVYQT

SEQ ID NO: 55 - DNA, 3285 bp, Paenibacillus sp
  CDS (1)..(3282)
  sig_peptide (1)..(114)
  mat_peptide (115)..(3282)
atggccatcatgcagggtgttccaacctttaataagcggctgatttcggcatgcctggtactgtcgatgattgttccggcaccgatgacgctcatggtcgatcgggtgcaggcaaacgcaagcctggttcaaagcgtgaatgtgtcccaagcgggctatagcgcaggcgatttcaagacggccacggtaacggcgacggataagctgagcgataccagctaccagatcctgcaaggttccacggttatcgcatccggaaccatgagagatgaaggcaaagtatggggcaagcaagtgtatgccatcgatttctcgtccgtcacggcaaccgggaccgatttcatgattcgcagcaatggggtttcgtcgtacaggttcccgatccaggtgaatatgtggagcgaatataaggatgaaatgaccgctttttaccggctgcagcgaactacggatacgcgcgcggcttatccgcccgggtacagcagcgccgcgccttcgaacaagctcttccatccggattcctttcttgacgatgcgttctccgcggatcgcacccgtcattatgacttgtccggcggatggttcgatgcgggagattacggcaagtatggcggaaaccaatgggtgcaggggaatatcgccatctcctatttgcgtcatgcctcggcagctgcggtcaacttcgatcaagatcacaacggcatcccggatttagtggacgaagctgtctttggcagtcaatacttggtcaaattcgccgaccagcttgacggcgccatccataatattttgaggaagggagggttcgtgctgccccacaaggtaacggatcaaatgccggggaattccgacgatcgcgcgttggaagccgtggaagcggtcgggggctccggaaaatcggccggttcgctcgcggcgacggcgcgcgcgattcgcaccgccatcgccaatggcaaagtcgcggcggataaagtcgcgcagctgcaggggcttgcggacgatttcgaggcagcggcgctcgtcttctacaattacaccctcgcccatcagaacgggaaccatggctcctatgggacgttgaacaacggcgggatcgccaatcctctgttatgggccgaagtgcagctgtatctgctgaccggcgacgtcgcttacaagaatcaagctcaggcgcgcataagcgtcctgaatgaaacctacacctcgtccacgaattattgggatatgcatccgattacgctggctgaattttatccggctgcggacagcgccattaaaacgaaaattcaaagcatcctcaaacatcaagcgtattatttcatcacgctcatggatgaaacgccttacggcgtcttgaatcagttcggcagcttcggcgtgaacgagccgcatgcctcctatatggccgatgtgctccgttactatgaattatttcaggatccggtcgcgcttcgagccgttaacaaggccttgtactggattgtcggcaataacccgtggaatataagctgggtatccggcgtcggatcggacttcaccgatttcttgcacacgcggctggacgaagagtcctacagccagacgaatacgggcattgttctgcccggggcgatggtcagcggaccgaacatcaaggatccgcataacaagctgagcgcaagcccttggtacgaggataagcccctttgggtggacgacacgcatcaatggcgatacaacgagtacagcgtcagcattcagaccggcttgttctataccatcatgggattggctgccctcggagggaatgcttcctcaggcggagcggagcccgcgaagctgccgatcacttggcccatcatcggggattccgtgacgggagacgtgactgtattcgcgcagcccgagagtaatttgagcaatgtgaaatacaacgaaatggcgatgaaccaatcggacggtatttataccacatccgtaagcacaagcgatcttgcgccgtattcggagcgaagagtgcagattaaagggaccgacggcaatggaattaccagctacagcaatacgcatttcacggtggcgcctgcactgccggatcctgctcacccgttgtcgtacgacgactttaaccagaatggaatctggggcagtcagaagtttgattgggtgaattggtacaaccaaaacggaggtacggccgcctacaagcggacaacggtcgatggacgaacagtcgggcaatttgcgcaaacgccggcttcgacgacatccaaagcgaagttccagccgtggaaatacaatgcgaatttgagcggctaccgctatttgaacttcaccatgaaaaatccgggctatcccaataccaaaatccgcatcgccgccaatgacggcaccaaagcctacaatctaaccggcggggaagttgccgttgccggcgattggacgacgtaccaatatgatctgaatctgttcccggcactgaataagagtaaggtgctccttgaggtatggttaagcaatccgaccacgggacaatacggggagattctgattgacgatattacggccgtaagtaaggtaagcggcagcgcgccgacgctctccgcgacaggggtgaacgcggccagcgggcaagaatcgacgttgttcaccttcaatgcgacctacacggatgcggataacaacgcgccatatgatgtccaggttgtcattgatggcgtcatccgctcgatgaaggagcaggatgccgccgacgccaattttacggacgggaaagtctacacgtataccacgaccctgcccgtagggacgcataagcattattttagaacgacggataccacgacgaatgtcatcagcaccgccgtacaggctgccccgtccgtcatccggagtaaattcgaggcggaagccttgacggtccaatcggcgaacgatacgcacgcggtcaaagaccatccggatgccagcgccgggaagtatcgcttattcaatggccgccaggccaatgcttatatcgaatatgccgtgaatgttcctcaagctggaacctaccaagtaacggtgcgagcgatgcgactaagcgataacgggatctatcagctgctcattaacgggaacaaccaaggcgctccgttcgacacctaccagacatcgggcaaatacgcggactacgcgctggggaatgtgacgatcagcagtccgggaacgcagctgttccgatttaaagcgacgggcaagcatgcaagttcattcgggtataagcttcccgttgattacattcagcttgtttccgtgaccccttaa

SEQ ID NO: 56 - protein, 1094 aa, Paenibacillus sp
MAIMQGVPTFNKRLISACLVLSMIVPAPMTLMVDRVQANASLVQSVNVSQAGYSAGDFKTATVTATDKLSDTSYQILQGSTVIASGTMRDEGKVWGKQVYAIDFSSVTATGTDFMIRSNGVSSYRFPIQVNMWSEYKDEMTAFYRLQRTTDTRAAYPPGYSSAAPSNKLFHPDSFLDDAFSADRTRHYDLSGGWFDAGDYGKYGGNQWVQGNIAISYLRHASAAAVNFDQDHNGIPDLVDEAVFGSQYLVKFADQLDGAIHNILRKGGFVLPHKVTDQMPGNSDDRALEAVEAVGGSGKSAGSLAATARAIRTAIANGKVAADKVAQLQGLADDFEAAALVFYNYTLAHQNGNHGSYGTLNNGGIANPLLWAEVQLYLLTGDVAYKNQAQARISVLNETYTSSTNYWDMHPITLAEFYPAADSAIKTKIQSILKHQAYYFITLMDETPYGVLNQFGSFGVNEPHASYMADVLRYYELFQDPVALRAVNKALYWIVGNNPWNISWVSGVGSDFTDFLHTRLDEESYSQTNTGIVLPGAMVSGPNIKDPHNKLSASPWYEDKPLWVDDTHQWRYNEYSVSIQTGLFYTIMGLAALGGNASSGGAEPAKLPITWPIIGDSVTGDVTVFAQPESNLSNVKYNEMAMNQSDGIYTTSVSTSDLAPYSERRVQIKGTDGNGITSYSNTHFTVAPALPDPAHPLSYDDFNQNGIWGSQKFDWVNWYNQNGGTAAYKRTTVDGRTVGQFAQTPASTTSKAKFQPWKYNANLSGYRYLNFTMKNPGYPNTKIRIAANDGTKAYNLTGGEVAVAGDWTTYQYDLNLFPALNKSKVLLEVWLSNPTTGQYGEILIDDITAVSKVSGSAPTLSATGVNAASGQESTLFTFNATYTDADNNAPYDVQVVIDGVIRSMKEQDAADANFTDGKVYTYTTTLPVGTHKHYFRTTDTTTNVISTAVQAAPSVIRSKFEAEALTVQSANDTHAVKDHPDASAGKYRLFNGRQANAYIEYAVNVPQAGTYQVTVRAMRLSDNGIYQLLINGNNQGAPFDTYQTSGKYADYALGNVTISSPGTQLFRFKATGKHASSFGYKLPVDYIQLVSVTP

SEQ ID NO: 57 - DNA, 3276 bp, Artificial Sequence
  Synthetic construct
  CDS (1)..(3273)
  sig_peptide (1)..(81)
  mat_peptide (82)..(3273)
atgaagaaaccgttggggaaaattgtcgcaagcaccgcactactcatttctgttgcttttagttcatcgatagcatcagcacatcatcatcaccatcatcctaggaacgcaagcctggttcaaagcgtgaatgtgtcccaagcgggctatagcgcaggcgatttcaagacggccacggtaacggcgacggataagctgagcgataccagctaccagatcctgcaaggttccacggttatcgcatccggaaccatgagagatgaaggcaaagtatggggcaagcaagtgtatgccatcgatttctcgtccgtcacggcaaccgggaccgatttcatgattcgcagcaatggggtttcgtcgtacaggttcccgatccaggtgaatatgtggagcgaatataaggatgaaatgaccgctttttaccggctgcagcgaactacggatacgcgcgcggcttatccgcccgggtacagcagcgccgcgccttcgaacaagctcttccatccggattcctttcttgacgatgcgttctccgcggatcgcacccgtcattatgacttgtccggcggatggttcgatgcgggagattacggcaagtatggcggaaaccaatgggtgcaggggaatatcgccatctcctatttgcgtcatgcctcggcagctgcggtcaacttcgatcaagatcacaacggcatcccggatttagtggacgaagctgtctttggcagtcaatacttggtcaaattcgccgaccagcttgacggcgccatccataatattttgaggaagggagggttcgtgctgccccacaaggtaacggatcaaatgccggggaattccgacgatcgcgcgttggaagccgtggaagcggtcgggggctccggaaaatcggccggttcgctcgcggcgacggcgcgcgcgattcgcaccgccatcgccaatggcaaagtcgcggcggataaagtcgcgcagctgcaggggcttgcggacgatttcgaggcagcggcgctcgtcttctacaattacaccctcgcccatcagaacgggaaccatggctcctatgggacgttgaacaacggcgggatcgccaatcctctgttatgggccgaagtgcagctgtatctgctgaccggcgacgtcgcttacaagaatcaagctcaggcgcgcataagcgtcctgaatgaaacctacacctcgtccacgaattattgggatatgcatccgattacgctggctgaattttatccggctgcggacagcgccattaaaacgaaaattcaaagcatcctcaaacatcaagcgtattatttcatcacgctcatggatgaaacgccttacggcgtcttgaatcagttcggcagcttcggcgtgaacgagccgcatgcctcctatatggccgatgtgctccgttactatgaattatttcaggatccggtcgcgcttcgagccgttaacaaggccttgtactggattgtcggcaataacccgtggaatataagctgggtatccggcgtcggatcggacttcaccgatttcttgcacacgcggctggacgaagagtcctacagccagacgaatacgggcattgttctgcccggggcgatggtcagcggaccgaacatcaaggatccgcataacaagctgagcgcaagcccttggtacgaggataagcccctttgggtggacgacacgcatcaatggcgatacaacgagtacagcgtcagcattcagaccggcttgttctataccatcatgggattggctgccctcggagggaatgcttcctcaggcggagcggagcccgcgaagctgccgatcacttggcccatcatcggggattccgtgacgggagacgtgactgtattcgcgcagcccgagagtaatttgagcaatgtgaaatacaacgaaatggcgatgaaccaatcggacggtatttataccacatccgtaagcacaagcgatcttgcgccgtattcggagcgaagagtgcagattaaagggaccgacggcaatggaattaccagctacagcaatacgcatttcacggtggcgcctgcactgccggatcctgctcacccgttgtcgtacgacgactttaaccagaatggaatctggggcagtcagaagtttgattgggtgaattggtacaaccaaaacggaggtacggccgcctacaagcggacaacggtcgatggacgaacagtcgggcaatttgcgcaaacgccggcttcgacgacatccaaagcgaagttccagccgtggaaatacaatgcgaatttgagcggctaccgctatttgaacttcaccatgaaaaatccgggctatcccaataccaaaatccgcatcgccgccaatgacggcaccaaagcctacaatctaaccggcggggaagttgccgttgccggcgattggacgacgtaccaatatgatctgaatctgttcccggcactgaataagagtaaggtgctccttgaggtatggttaagcaatccgaccacgggacaatacggggagattctgattgacgatattacggccgtaagtaaggtaagcggcagcgcgccgacgctctccgcgacaggggtgaacgcggccagcgggcaagaatcgacgttgttcaccttcaatgcgacctacacggatgcggataacaacgcgccatatgatgtccaggttgtcattgatggcgtcatccgctcgatgaaggagcaggatgccgccgacgccaattttacggacgggaaagtctacacgtataccacgaccctgcccgtagggacgcataagcattattttagaacgacggataccacgacgaatgtcatcagcaccgccgtacaggctgccccgtccgtcatccggagtaaattcgaggcggaagccttgacggtccaatcggcgaacgatacgcacgcggtcaaagaccatccggatgccagcgccgggaagtatcgcttattcaatggccgccaggccaatgcttatatcgaatatgccgtgaatgttcctcaagctggaacctaccaagtaacggtgcgagcgatgcgactaagcgataacgggatctatcagctgctcattaacgggaacaaccaaggcgctccgttcgacacctaccagacatcgggcaaatacgcggactacgcgctggggaatgtgacgatcagcagtccgggaacgcagctgttccgatttaaagcgacgggcaagcatgcaagttcattcgggtataagcttcccgttgattacattcagcttgtttccgtgaccccttaa

SEQ ID NO: 58 - protein, 1091 aa, Artificial Sequence
  Synthetic Construct
MKKPLGKIVASTALLISVAFSSSIASAHHHHHHPRNASLVQSVNVSQAGYSAGDFKTATVTATDKLSDTSYQILQGSTVIASGTMRDEGKVWGKQVYAIDFSSVTATGTDFMIRSNGVSSYRFPIQVNMWSEYKDEMTAFYRLQRTTDTRAAYPPGYSSAAPSNKLFHPDSFLDDAFSADRTRHYDLSGGWFDAGDYGKYGGNQWVQGNIAISYLRHASAAAVNFDQDHNGIPDLVDEAVFGSQYLVKFADQLDGAIHNILRKGGFVLPHKVTDQMPGNSDDRALEAVEAVGGSGKSAGSLAATARAIRTAIANGKVAADKVAQLQGLADDFEAAALVFYNYTLAHQNGNHGSYGTLNNGGIANPLLWAEVQLYLLTGDVAYKNQAQARISVLNETYTSSTNYWDMHPITLAEFYPAADSAIKTKIQSILKHQAYYFITLMDETPYGVLNQFGSFGVNEPHASYMADVLRYYELFQDPVALRAVNKALYWIVGNNPWNISWVSGVGSDFTDFLHTRLDEESYSQTNTGIVLPGAMVSGPNIKDPHNKLSASPWYEDKPLWVDDTHQWRYNEYSVSIQTGLFYTIMGLAALGGNASSGGAEPAKLPITWPIIGDSVTGDVTVFAQPESNLSNVKYNEMAMNQSDGIYTTSVSTSDLAPYSERRVQIKGTDGNGITSYSNTHFTVAPALPDPAHPLSYDDFNQNGIWGSQKFDWVNWYNQNGGTAAYKRTTVDGRTVGQFAQTPASTTSKAKFQPWKYNANLSGYRYLNFTMKNPGYPNTKIRIAANDGTKAYNLTGGEVAVAGDWTTYQYDLNLFPALNKSKVLLEVWLSNPTTGQYGEILIDDITAVSKVSGSAPTLSATGVNAASGQESTLFTFNATYTDADNNAPYDVQVVIDGVIRSMKEQDAADANFTDGKVYTYTTTLPVGTHKHYFRTTDTTTNVISTAVQAAPSVIRSKFEAEALTVQSANDTHAVKDHPDASAGKYRLFNGRQANAYIEYAVNVPQAGTYQVTVRAMRLSDNGIYQLLINGNNQGAPFDTYQTSGKYADYALGNVTISSPGTQLFRFKATGKHASSFGYKLPVDYIQLVSVTP

SEQ ID NO: 59 - DNA, 2814 bp, Paenibacillus sp
  CDS (1)..(2811)
  sig_peptide (1)..(123)
  mat_peptide (124)..(2811)
atgagagggttgggaaagagagaaacgttaacgggaaggttactcatgaaaagcggcttggtggcgttagtgctgctgctgtcgatcagcgggttggggggagtaacggaacgtgcccgtgcggcggatgaattcgacgggatgcgggagaaccggaaggcgatgcttacaggaggtccctccctgaatacggcggacgctgatattgctgcagccctcaccaagctggcgaacgaagcgaacggctactggcagacgatgaataccgcgcccagccgtacctatctgtggagcgataacccgggcatcgggaactcgattcatatccgggtgacctatgaacggctgaagacgatggcgcttgcgtatgccactgctggtacggcgctgtatgaggacagtcagctcgggagcgatatcgtggctgcactcgattatatgtacaccacccgatatcacgaggcggtaacgccgactgccagcggaacgagtaactggtgggattggcagatcggcattcctatgcagcttaatgatacggcggtgctgatgtatgacgttttgagcccggctcaagtcactaattatatgacagcggtggaacgcttctcgcccgcagttaccttaaccggagccaaccgtgcctggaaagcgatagttgtaggtgagcggggaattctcgtcaaagacgggaccaagatcgccgccgctcgcgatggcctgtcctctattttcaattatacgcttagcggagacggcttctaccgggatggttcattcattcagcataacaatatcccttacaccggaggttatggaattgatctgctgctggccgtcagtgatctgatggtgatgcttcacggctcttcctggcaggtcgctgatcccaagcagtccaatgtgtgggaatgggtgtataactcctatcagccggtgatgtacaagggggcgataatggacatggtccgaggccgggaaatctccagacattacagtcaggaccatgaagcagggcatcgtgtgatgcaagggattctgctgctgtctgcaattgcgccgccatctcaatcagcagattttaagaagatgcttaaaggctggattctatcggatacattcaaatccttctatgctgatgcctccgtacccgctatcgctcaggccaagacgataaccggggacccgttgattgaaccggcggcagagcttataggttataagcagttctcggcgatggaccgggctgttcagcaccggccgggctatagtttcgggcttgcgatgtattccagccgcataagcagctacgaagcgatcaacagcgagaacgccaaagcctggtatacctcggcgggtatgaccagcttatataacagtgatcttggacaatacagtgatgattactggccaacagttgatagttaccgcctgccgggaacaacggtgctgtcccagacctcctcaaccagccacaccagcactaagccgtggactggtggcaccgatatccagaatctatatggaagctcgggtatggatttgcagtacacaggccgtacgcttggagccaagaaatcttggtttatgttcgatgatgaagtagttgctctcggcgcagggatcagcagcacggataatattgctgtggagacgatcgttgagaaccggaagctgaacacggcgggcagcaatacgctaactgtgaacggtgaagtgcagcctgccattttgggcggggcatcgaccctggatcaggtggagtgggctcatttgtcgggaagcaccgccggtgcggatacgggatattattttccgcagacgatatcgcttgctgctaagagagaagccagaacaggcaactggaagcagatcaacccccgtccagtcacaccttccacgccgatcacccgcaattatatgaccttatggctggatcatggtgtcaatccgagtaacggcgaatatcaatatgtcctgctgccgggcaagacagccgctcaagtagccgcttatgctgctgctccagacattgaagtacttgcgaattcatccagtgttcaggcggtaaaagaaacgaagctcggcatcatcggagcgaatttctgggaggatggggtaaactccgccgatctgatcaccgttaacaagaaatcggcggttatgacccgggaagccggggatacattggagctgtctgtcagcgatccgacccaagcaggcaccggtgtgattgaggtggagctggaccgttcggcaagcgcttatacggcggataccgggattacggtgacacagctcagcccgaccatccaattaaccgtgaatgtcagcgcggccaagggcaagacgttcaaggcttcctttgatctgggcagcggtataccgccgacccttcctggggaagaggttattgtagacaataacgatactacaggggtgctgaagactggaggctggaagaccgctgcggtgcagactgaccggtacggcgtgaactatctgcatgatgacaacagtggcaaaggcagtaaaagtgtgaccttcacgccagacttacccgtcacagctacctacagcgtctatatgatgtggccgcagcatatcaaccgctccactgcgatccccatagacattgttcatgccggagggacggctacgcacagtatagaccagacctcaaacggcggggtatggaatttcatcggcacatatcccttcacagccggttccttgggtagcgtgactattcgtaacaacggaacaagcgggtatgtagccgccgatgcagtcaaatttgtacgtaatccgtaa

SEQ ID NO: 60 - protein, 937 aa, Paenibacillus sp
MRGLGKRETLTGRLLMKSGLVALVLLLSISGLGGVTERARAADEFDGMRENRKAMLTGGPSLNTADADIAAALTKLANEANGYWQTMNTAPSRTYLWSDNPGIGNSIHIRVTYERLKTMALAYATAGTALYEDSQLGSDIVAALDYMYTTRYHEAVTPTASGTSNWWDWQIGIPMQLNDTAVLMYDVLSPAQVTNYMTAVERFSPAVTLTGANRAWKAIVVGERGILVKDGTKIAAARDGLSSIFNYTLSGDGFYRDGSFIQHNNIPYTGGYGIDLLLAVSDLMVMLHGSSWQVADPKQSNVWEWVYNSYQPVMYKGAIMDMVRGREISRHYSQDHEAGHRVMQGILLLSAIAPPSQSADFKKMLKGWILSDTFKSFYADASVPAIAQAKTITGDPLIEPAAELIGYKQFSAMDRAVQHRPGYSFGLAMYSSRISSYEAINSENAKAWYTSAGMTSLYNSDLGQYSDDYWPTVDSYRLPGTTVLSQTSSTSHTSTKPWTGGTDIQNLYGSSGMDLQYTGRTLGAKKSWFMFDDEVVALGAGISSTDNIAVETIVENRKLNTAGSNTLTVNGEVQPAILGGASTLDQVEWAHLSGSTAGADTGYYFPQTISLAAKREARTGNWKQINPRPVTPSTPITRNYMTLWLDHGVNPSNGEYQYVLLPGKTAAQVAAYAAAPDIEVLANSSSVQAVKETKLGIIGANFWEDGVNSADLITVNKKSAVMTREAGDTLELSVSDPTQAGTGVIEVELDRSASAYTADTGITVTQLSPTIQLTVNVSAAKGKTFKASFDLGSGIPPTLPGEEVIVDNNDTTGVLKTGGWKTAAVQTDRYGVNYLHDDNSGKGSKSVTFTPDLPVTATYSVYMMWPQHINRSTAIPIDIVHAGGTATHSIDQTSNGGVWNFIGTYPFTAGSLGSVTIRNNGTSGYVAADAVKFVRNP

SEQ ID NO: 61 - DNA, 2796 bp, Artificial Sequence
  Synthetic construct
  CDS (1)..(2793)
  sig_peptide (1)..(81)
  mat_peptide (82)..(2793)
atgaagaaaccgttggggaaaattgtcgcaagcaccgcactactcatttctgttgcttttagttcatcgatagcatcagcacatcatcatcaccatcatcctagggcggatgaattcgacgggatgcgggagaaccggaaggcgatgcttacaggaggtccctccctgaatacggcggacgctgatattgctgcagccctcaccaagctggcgaacgaagcgaacggctactggcagacgatgaataccgcgcccagccgtacctatctgtggagcgataacccgggcatcgggaactcgattcatatccgggtgacctatgaacggctgaagacgatggcgcttgcgtatgccactgctggtacggcgctgtatgaggacagtcagctcgggagcgatatcgtggctgcactcgattatatgtacaccacccgatatcacgaggcggtaacgccgactgccagcggaacgagtaactggtgggattggcagatcggcattcctatgcagcttaatgatacggcggtgctgatgtatgacgttttgagcccggctcaagtcactaattatatgacagcggtggaacgcttctcgcccgcagttaccttaaccggagccaaccgtgcctggaaagcgatagttgtaggtgagcggggaattctcgtcaaagacgggaccaagatcgccgccgctcgcgatggcctgtcctctattttcaattatacgcttagcggagacggcttctaccgggatggttcattcattcagcataacaatatcccttacaccggaggttatggaattgatctgctgctggccgtcagtgatctgatggtgatgcttcacggctcttcctggcaggtcgctgatcccaagcagtccaatgtgtgggaatgggtgtataactcctatcagccggtgatgtacaagggggcgataatggacatggtccgaggccgggaaatctccagacattacagtcaggaccatgaagcagggcatcgtgtgatgcaagggattctgctgctgtctgcaattgcgccgccatctcaatcagcagattttaagaagatgcttaaaggctggattctatcggatacattcaaatccttctatgctgatgcctccgtacccgctatcgctcaggccaagacgataaccggggacccgttgattgaaccggcggcagagcttataggttataagcagttctcggcgatggaccgggctgttcagcaccggccgggctatagtttcgggcttgcgatgtattccagccgcataagcagctacgaagcgatcaacagcgagaacgccaaagcctggtatacctcggcgggtatgaccagcttatataacagtgatcttggacaatacagtgatgattactggccaacagttgatagttaccgcctgccgggaacaacggtgctgtcccagacctcctcaaccagccacaccagcactaagccgtggactggtggcaccgatatccagaatctatatggaagctcgggtatggatttgcagtacacaggccgtacgcttggagccaagaaatcttggtttatgttcgatgatgaagtagttgctctcggcgcagggatcagcagcacggataatattgctgtggagacgatcgttgagaaccggaagctgaacacggcgggcagcaatacgctaactgtgaacggtgaagtgcagcctgccattttgggcggggcatcgaccctggatcaggtggagtgggctcatttgtcgggaagcaccgccggtgcggatacgggatattattttccgcagacgatatcgcttgctgctaagagagaagccagaacaggcaactggaagcagatcaacccccgtccagtcacaccttccacgccgatcacccgcaattatatgaccttatggctggatcatggtgtcaatccgagtaacggcgaatatcaatatgtcctgctgccgggcaagacagccgctcaagtagccgcttatgctgctgctccagacattgaagtacttgcgaattcatccagtgttcaggcggtaaaagaaacgaagctcggcatcatcggagcgaatttctgggaggatggggtaaactccgccgatctgatcaccgttaacaagaaatcggcggttatgacccgggaagccggggatacattggagctgtctgtcagcgatccgacccaagcaggcaccggtgtgattgaggtggagctggaccgttcggcaagcgcttatacggcggataccgggattacggtgacacagctcagcccgaccatccaattaaccgtgaatgtcagcgcggccaagggcaagacgttcaaggcttcctttgatctgggcagcggtataccgccgacccttcctggggaagaggttattgtagacaataacgatactacaggggtgctgaagactggaggctggaagaccgctgcggtgcagactgaccggtacggcgtgaactatctgcatgatgacaacagtggcaaaggcagtaaaagtgtgaccttcacgccagacttacccgtcacagctacctacagcgtctatatgatgtggccgcagcatatcaaccgctccactgcgatccccatagacattgttcatgccggagggacggctacgcacagtatagaccagacctcaaacggcggggtatggaatttcatcggcacatatcccttcacagccggttccttgggtagcgtgactattcgtaacaacggaacaagcgggtatgtagccgccgatgcagtcaaatttgtacgtaatccgtaa

SEQ ID NO: 62 - protein, 931 aa, Artificial Sequence
  Synthetic Construct
MKKPLGKIVASTALLISVAFSSSIASAHHHHHHPRADEFDGMRENRKAMLTGGPSLNTADADIAAALTKLANEANGYWQTMNTAPSRTYLWSDNPGIGNSIHIRVTYERLKTMALAYATAGTALYEDSQLGSDIVAALDYMYTTRYHEAVTPTASGTSNWWDWQIGIPMQLNDTAVLMYDVLSPAQVTNYMTAVERFSPAVTLTGANRAWKAIVVGERGILVKDGTKIAAARDGLSSIFNYTLSGDGFYRDGSFIQHNNIPYTGGYGIDLLLAVSDLMVMLHGSSWQVADPKQSNVWEWVYNSYQPVMYKGAIMDMVRGREISRHYSQDHEAGHRVMQGILLLSAIAPPSQSADFKKMLKGWILSDTFKSFYADASVPAIAQAKTITGDPLIEPAAELIGYKQFSAMDRAVQHRPGYSFGLAMYSSRISSYEAINSENAKAWYTSAGMTSLYNSDLGQYSDDYWPTVDSYRLPGTTVLSQTSSTSHTSTKPWTGGTDIQNLYGSSGMDLQYTGRTLGAKKSWFMFDDEVVALGAGISSTDNIAVETIVENRKLNTAGSNTLTVNGEVQPAILGGASTLDQVEWAHLSGSTAGADTGYYFPQTISLAAKREARTGNWKQINPRPVTPSTPITRNYMTLWLDHGVNPSNGEYQYVLLPGKTAAQVAAYAAAPDIEVLANSSSVQAVKETKLGIIGANFWEDGVNSADLITVNKKSAVMTREAGDTLELSVSDPTQAGTGVIEVELDRSASAYTADTGITVTQLSPTIQLTVNVSAAKGKTFKASFDLGSGIPPTLPGEEVIVDNNDTTGVLKTGGWKTAAVQTDRYGVNYLHDDNSGKGSKSVTFTPDLPVTATYSVYMMWPQHINRSTAIPIDIVHAGGTATHSIDQTSNGGVWNFIGTYPFTAGSLGSVTIRNNGTSGYVAADAVKFVRNP

SEQ ID NO: 63 - DNA, 3189 bp, Paenibacillus sp
  CDS (1)..(3186)
  sig_peptide (1)..(72)
  mat_peptide (73)..(3195)
atgagcttatttcttgcggtcattttggtaagtgtgactctattcgcagctccggcacaagaggctgatgcggcggacgagtttgacacgctaagggaaaagtataaggccatgctgaacggagggacaacctataatctctccgacccggatatagcggcgcgtgttaatgccattacggtgactgcccagggatactgggactccatgcttaaagatccgaaccgtaaccgtctttggaacgatgcaccctttggctcggattcgacttccatcaccacgacctacagacacctttatgatatggcgctagcttatacgacttatggctccagtctgcagggcaatgccgcacttaaagcggatattatcagcggtttggactggatgaatgccaatcaattttataatggctgcagccaatatcaaaactggtggcactggcaaattggcggtcccatggccttgaatgatatcgtggcattaatgtacacggagctaaccgcaacacaaatttccaattacatggcggccatttattacacccaagcgagtgttacgatgacgggggcaaaccggctatgggaaagtcaggttattgccatctccggaatcttgaataaggattccgccagagttgccgctggtcgggatggcatcagcgctttgctgccgtatgtcgccaagggtgacggattttacaacgatggatcattcgttcagcatacttattatgcttacaacggtggttatggttcagagctgttatctggcattgcagacttgatatttattttgaatggctcttcatggcaggtaacggatcctaataaaaacaatgtataccgttggatttatgattcctacgagcctttcatctataaagggaatctgatggacatggtccgcggtagagagatctcaaggcatggattgcaggacgataaggcagccgtgactgtgatggcatcgatcattcgtctgtcacaaaccgctgcttccgccgatgctaccgcatttaagagaatggtgaaatattggctgctgctggatacggataagactttccttaaagcagtatcgattgatctgattattgccgcgaaccaactggtgaacgattccaccgttacctctcgaggggagctagtgaaatataaacaattctccggaatggaccgcgctgtacagcttagacctggcttcggttttgggcttagcatgttttccagccggatcggtaattatgagtcgattaatgcagagaacaacaaaggctggcataccggcgacggcatgacctacctttacaatactgacctgagtcagttcaatgaccatttctgggcaactgtggataattaccgattgccgggtaccacagtgctccagaacacgacgcaaaccgcgaacagccgcagcgacaaaagctgggccggaggaacggatattcttgggcaatatggtgtttccggcatggaactgcataccgtaggtaagagcctgacagccaagaaatcctggttcatgtttgacgatgagatcgtcgcgctgggttcaggtattgccagcaccgatggcatcgcaaccgaaacgattgtagagaatcgaaagctcaatagcagcggcaataatgcattgattgttaacgggacggcgaagccgggctcccttggatggtcggaaacaatgaccggaaccaattatattcatctagccggcagcgtacccggctccgatatcggttattattttcctggtggagcagcagtcaaaggcttgcgtgaagcccggtcgggaagctggagctcgctgaattcctccgcatcctggaaggactcgacattgcatacacgcaactttatgacgctttggttcgatcatggcatgaacccgacaaacggtagttattcttatgtgctgcttccgaataagaccagcagtgcggtggccagctatgctgcaacgcctcagatcagcattctggagaattctagctcggcgcaagcggtgaaggagacgcaattgaatgtcaccggaattaacttttggaacgatgagccaaccacggtgggcctggttacttccaatcggaaagcatccgttatgacaaaagaaacggctagtgatttcgagatatccgtttccgacccgacccaaagtaatgtggggaccatctatattgatgtcaacaaaagtgcaaccggattgatttcgaaggataatgaaataacggtcattcagtactacccaaccatgaagtttaaagtcaatgtaaacaattctggcgggaagtcctataaagtaaagtttagcctgacaggaacacccggcagcaacccgtctccaatcccgataccgaatccttacgaagcggaagctttgccaattaacgctctgacagatactcccgtggtttacaatgatgccaatgccagtggtggcaagaagcttggcttcaataacaatgcagtggatgattatgtggagttcagtctggacgtcacacagcccggcacctacgatgtcaaatcccggattatgaaatcaacgaacagcgggatttatcagctgtctattaatgggaccaacgtagggagcgcgcaggatatgttctggacgacctccgagctgtctaaggagtttactatgggctcatacagcttcagcacacccgggagctatttgttccgattaaaaacaaccggcaagaatgtcagttcttcaggatataagctgatgctggacaattttagtctggtatcaacaggtattgatacaacggtgattgtggacaatgccgatgcagctggtgttacgaaggtgggtacttggaccggaaccaatacgcagaccgatcggtacggcgccgactacattcacgatgggaacacggggaaaggtacgaagagcgttacctttactccaaatgtacctatcagtggaacttatcaggtttacatgatgtgggctgcccatacgaatagggcaacgaatgttcccgtagacgtaacgcattcaggcggtacagcaacgctaaatgttaaccaacaaggtaatggtggtgtgtggaatttactgggtacgtatagctttaatgctgggtccacgggggctatcaagatccgtacggacgcgacgaatggatatgttgtagccgatgccgtgaagctggtaaaggtcccataa

SEQ ID NO: 64 - protein, 1062 aa, Paenibacillus sp
MSLFLAVILVSVTLFAAPAQEADAADEFDTLREKYKAMLNGGTTYNLSDPDIAARVNAITVTAQGYWDSMLKDPNRNRLWNDAPFGSDSTSITTTYRHLYDMALAYTTYGSSLQGNAALKADIISGLDWMNANQFYNGCSQYQNWWHWQIGGPMALNDIVALMYTELTATQISNYMAAIYYTQASVTMTGANRLWESQVIAISGILNKDSARVAAGRDGISALLPYVAKGDGFYNDGSFVQHTYYAYNGGYGSELLSGIADLIFILNGSSWQVTDPNKNNVYRWIYDSYEPFIYKGNLMDMVRGREISRHGLQDDKAAVTVMASIIRLSQTAASADATAFKRMVKYWLLLDTDKTFLKAVSIDLIIAANQLVNDSTVTSRGELVKYKQFSGMDRAVQLRPGFGFGLSMFSSRIGNYESINAENNKGWHTGDGMTYLYNTDLSQFNDHFWATVDNYRLPGTTVLQNTTQTANSRSDKSWAGGTDILGQYGVSGMELHTVGKSLTAKKSWFMFDDEIVALGSGIASTDGIATETIVENRKLNSSGNNALIVNGTAKPGSLGWSETMTGTNYIHLAGSVPGSDIGYYFPGGAAVKGLREARSGSWSSLNSSASWKDSTLHTRNFMTLWFDHGMNPTNGSYSYVLLPNKTSSAVASYAATPQISILENSSSAQAVKETQLNVTGINFWNDEPTTVGLVTSNRKASVMTKETASDFEISVSDPTQSNVGTIYIDVNKSATGLISKDNEITVIQYYPTMKFKVNVNNSGGKSYKVKFSLTGTPGSNPSPIPIPNPYEAEALPINALTDTPVVYNDANASGGKKLGFNNNAVDDYVEFSLDVTQPGTYDVKSRIMKSTNSGIYQLSINGTNVGSAQDMFWTTSELSKEFTMGSYSFSTPGSYLFRLKTTGKNVSSSGYKLMLDNFSLVSTGIDTTVIVDNADAAGVTKVGTWTGTNTQTDRYGADYIHDGNTGKGTKSVTFTPNVPISGTYQVYMMWAAHTNRATNVPVDVTHSGGTATLNVNQQGNGGVWNLLGTYSFNAGSTGAIKIRTDATNGYVVADAVKLVKVP

SEQ ID NO: 65 - DNA, 3222 bp, Artificial Sequence
  Synthetic construct
  CDS (1)..(3219)
  sig_peptide (1)..(81)
  mat_peptide (82)..(3219)
atgaagaaaccgttggggaaaattgtcgcaagcaccgcactactcatttctgttgcttttagttcatcgatagcatcagcacatcatcatcaccatcatcctagggcggacgagtttgacacgctaagggaaaagtataaggccatgctgaacggagggacaacctataatctctccgacccggatatagcggcgcgtgttaatgccattacggtgactgcccagggatactgggactccatgcttaaagatccgaaccgtaaccgtctttggaacgatgcaccctttggctcggattcgacttccatcaccacgacctacagacacctttatgatatggcgctagcttatacgacttatggctccagtctgcagggcaatgccgcacttaaagcggatattatcagcggtttggactggatgaatgccaatcaattttataatggctgcagccaatatcaaaactggtggcactggcaaattggcggtcccatggccttgaatgatatcgtggcattaatgtacacggagctaaccgcaacacaaatttccaattacatggcggccatttattacacccaagcgagtgttacgatgacgggggcaaaccggctatgggaaagtcaggttattgccatctccggaatcttgaataaggattccgccagagttgccgctggtcgggatggcatcagcgctttgctgccgtatgtcgccaagggtgacggattttacaacgatggatcattcgttcagcatacttattatgcttacaacggtggttatggttcagagctgttatctggcattgcagacttgatatttattttgaatggctcttcatggcaggtaacggatcctaataaaaacaatgtataccgttggatttatgattcctacgagcctttcatctataaagggaatctgatggacatggtccgcggtagagagatctcaaggcatggattgcaggacgataaggcagccgtgactgtgatggcatcgatcattcgtctgtcacaaaccgctgcttccgccgatgctaccgcatttaagagaatggtgaaatattggctgctgctggatacggataagactttccttaaagcagtatcgattgatctgattattgccgcgaaccaactggtgaacgattccaccgttacctctcgaggggagctagtgaaatataaacaattctccggaatggaccgcgctgtacagcttagacctggcttcggttttgggcttagcatgttttccagccggatcggtaattatgagtcgattaatgcagagaacaacaaaggctggcataccggcgacggcatgacctacctttacaatactgacctgagtcagttcaatgaccatttctgggcaactgtggataattaccgattgccgggtaccacagtgctccagaacacgacgcaaaccgcgaacagccgcagcgacaaaagctgggccggaggaacggatattcttgggcaatatggtgtttccggcatggaactgcataccgtaggtaagagcctgacagccaagaaatcctggttcatgtttgacgatgagatcgtcgcgctgggttcaggtattgccagcaccgatggcatcgcaaccgaaacgattgtagagaatcgaaagctcaatagcagcggcaataatgcattgattgttaacgggacggcgaagccgggctcccttggatggtcggaaacaatgaccggaaccaattatattcatctagccggcagcgtacccggctccgatatcggttattattttcctggtggagcagcagtcaaaggcttgcgtgaagcccggtcgggaagctggagctcgctgaattcctccgcatcctggaaggactcgacattgcatacacgcaactttatgacgctttggttcgatcatggcatgaacccgacaaacggtagttattcttatgtgctgcttccgaataagaccagcagtgcggtggccagctatgctgcaacgcctcagatcagcattctggagaattctagctcggcgcaagcggtgaaggagacgcaattgaatgtcaccggaattaacttttggaacgatgagccaaccacggtgggcctggttacttccaatcggaaagcatccgttatgacaaaagaaacggctagtgatttcgagatatccgtttccgacccgacccaaagtaatgtggggaccatctatattgatgtcaacaaaagtgcaaccggattgatttcgaaggataatgaaataacggtcattcagtactacccaaccatgaagtttaaagtcaatgtaaacaattctggcgggaagtcctataaagtaaagtttagcctgacaggaacacccggcagcaacccgtctccaatcccgataccgaatccttacgaagcggaagctttgccaattaacgctctgacagatactcccgtggtttacaatgatgccaatgccagtggtggcaagaagcttggcttcaataacaatgcagtggatgattatgtggagttcagtctggacgtcacacagcccggcacctacgatgtcaaatcccggattatgaaatcaacgaacagcgggatttatcagctgtctattaatgggaccaacgtagggagcgcgcaggatatgttctggacgacctccgagctgtctaaggagtttactatgggctcatacagcttcagcacacccgggagctatttgttccgattaaaaacaaccggcaagaatgtcagttcttcaggatataagctgatgctggacaattttagtctggtatcaacaggtattgatacaacggtgattgtggacaatgccgatgcagctggtgttacgaaggtgggtacttggaccggaaccaatacgcagaccgatcggtacggcgccgactacattcacgatgggaacacggggaaaggtacgaagagcgttacctttactccaaatgtacctatcagtggaacttatcaggtttacatgatgtgggctgcccatacgaatagggcaacgaatgttcccgtagacgtaacgcattcaggcggtacagcaacgctaaatgttaaccaacaaggtaatggtggtgtgtggaatttactgggtacgtatagctttaatgctgggtccacgggggctatcaagatccgtacggacgcgacgaatggatatgttgtagccgatgccgtgaagctggtaaaggtcccataa

SEQ ID NO: 66 - protein, 1073 aa, Artificial Sequence
  Synthetic Construct
MKKPLGKIVASTALLISVAFSSSIASAHHHHHHPRADEFDTLREKYKAMLNGGTTYNLSDPDIAARVNAITVTAQGYWDSMLKDPNRNRLWNDAPFGSDSTSITTTYRHLYDMALAYTTYGSSLQGNAALKADIISGLDWMNANQFYNGCSQYQNWWHWQIGGPMALNDIVALMYTELTATQISNYMAAIYYTQASVTMTGANRLWESQVIAISGILNKDSARVAAGRDGISALLPYVAKGDGFYNDGSFVQHTYYAYNGGYGSELLSGIADLIFILNGSSWQVTDPNKNNVYRWIYDSYEPFIYKGNLMDMVRGREISRHGLQDDKAAVTVMASIIRLSQTAASADATAFKRMVKYWLLLDTDKTFLKAVSIDLIIAANQLVNDSTVTSRGELVKYKQFSGMDRAVQLRPGFGFGLSMFSSRIGNYESINAENNKGWHTGDGMTYLYNTDLSQFNDHFWATVDNYRLPGTTVLQNTTQTANSRSDKSWAGGTDILGQYGVSGMELHTVGKSLTAKKSWFMFDDEIVALGSGIASTDGIATETIVENRKLNSSGNNALIVNGTAKPGSLGWSETMTGTNYIHLAGSVPGSDIGYYFPGGAAVKGLREARSGSWSSLNSSASWKDSTLHTRNFMTLWFDHGMNPTNGSYSYVLLPNKTSSAVASYAATPQISILENSSSAQAVKETQLNVTGINFWNDEPTTVGLVTSNRKASVMTKETASDFEISVSDPTQSNVGTIYIDVNKSATGLISKDNEITVIQYYPTMKFKVNVNNSGGKSYKVKFSLTGTPGSNPSPIPIPNPYEAEALPINALTDTPVVYNDANASGGKKLGFNNNAVDDYVEFSLDVTQPGTYDVKSRIMKSTNSGIYQLSINGTNVGSAQDMFWTTSELSKEFTMGSYSFSTPGSYLFRLKTTGKNVSSSGYKLMLDNFSLVSTGIDTTVIVDNADAAGVTKVGTWTGTNTQTDRYGADYIHDGNTGKGTKSVTFTPNVPISGTYQVYMMWAAHTNRATNVPVDVTHSGGTATLNVNQQGNGGVWNLLGTYSFNAGSTGAIKIRTDATNGYVVADAVKLVKVP

SEQ ID NO: 67 - DNA, 3237 bp, Artificial Sequence
  Synthetic construct
  sig_peptide (1)..(81)
  CDS (1)..(3234)
  mat_peptide (82)..(3234)
atgaagaaaccgttggggaaaattgtcgcaagcaccgcactactcatttctgttgcttttagttcatcgatagcatcagcacatcatcatcaccatcatcctagggcggaggcgtccgacatgttcgacgagcttagagaaaagtatgcaaccatgctgaccggagggacggcgtatagtctgtccgatccggatatcgccgcgcgggtggcgtcgattacgaccaacgcgcagacactgtggacctccatgaagaaggatgcgaacagagtgcggttatgggacaacgcgccgctcggcaacgattcggcgagcattacgaccagctaccggcagcttgcggccatggcgctcgcttaccgcacgtatggctccagcctgatgggtgatcccgacttgcgcgatgacattatcgacgggctggactggataaatacgttccagcacggcttctgcgaaggctgcagcatgtatcagaactggtggcattggcagatcggcggcccgattgcgcttaatgaagtcatcgcgcttatgtacgacgagctgacgcagacgcaaatcgacagctacatagcggcgatcaactatgcgcagccgagcgtgaacatgaccggggcaaacaggctttgggaaagccaggttatcgctttggcgggcatcaacggcaagaacggcgacaagatcgcgcatgcccgggacgggctgagcgcgctgctgacgtacgttgtgcagggggacggcttttacgaggacggctcgttcgtccagcattcctactactcctacaacggcgggtacggcctggatttgctgaagggcattgccgacttgacttatttgctgcacgactcgaactgggaagtcgtcgatccgaacaagcagaacattttcaactgggtatacgattccttcgagccgtttatttataacggaaatctgatggacatggtgcgggggcgggaaatatcgcggcatgcgaggcaaagcaacgtcgttggcgtcgaggccgtcgccgccattctgcgcttgtcccatgtagctccgcctgcggacgcggcagccttcaagagcatggtcaagcattggctccaggaaggcgggggaagccaattcctgcagcaagcttcgattacgcatatattgagcgcgcaggacgttctgaacgattccggcatcgtccctagaggcgaactggaagcttaccgccagtttgccggcatggaccgggcgctgcagctgcggcagggctacggcttcggcatcagcatgttttccagccggatcggcggccatgaagccattaacgcggagaacaacaaaggctggcataccggcgcgggcatgacttacttgtacaacaacgacttgagccagttcaacgatcatttctggccgactgtcaacagctaccggctgcccggtacgacggtgctgcgcgacacgccgcaagcggccaatacgcgaggcgacagatcctgggcgggcggtacggatatgctgggactatacggcataaccggtatggaatatcatgcaatcggcaaaagcttgaccgccaagaagtcctggttcatgtttgacgacgaaatcgtcgctctcggagcggacataacaagcggcgacggcgttgccgtcgaaacgatcgtcgaaaaccgcaagctgaacggtgcgggagacaattcgcttacggtgaacggcacggccaagccggcaacgctcggctggtcggagacgatgggcacgacaagctacgcacatcttgggggcagcgttgccgactcggatatcggctactacttcccggatggcggagcgacgctgcatgcccttcgcgaagcgcgcacaggcaattggcggcaaataaactcggcccagggctcgcccaatgcgccgcatacgcgaaactatttgaccatgtggctggagcatggcgtgaatccgtcgaatggggcttactcgtatgtgctgctgccgaacaagacgagcgcagcgacggcaagctatgctgcttcgcccgatattacgattattgaaaactcttcctccgcccaggcggtgaaggaaaacggcctcaatatgatcggcgtgaacttctggaataatgagcgaaagacggcagggggcattacttcgaatgccaaagcgtcggtcatgacgcgggaaacggcaagcgagttgaatgtatcggtgtccgatccgacgcagagcaatgtcggcatgatctatatcgagatcgacaaaagcgcaacggggcttattgcgaaggacgatgccgttacggtgctgcaatacagtccaacgatcaaattcaaggttgatgtgaacaaggcgcgcggcaagtcattcaaggcggcattcagcctgaccggcgcgcagcagccgaatcctgcgccaatcccgattcctaatccgtacgaggcggagctgctgccgatttccgcaacgacgaaaacgccgacgctcagcaatgacagcaacgcgagcggcggcaagaagctcggcctcaatagcagcgtcgtcggcgattacacggaattcagtctcgatgtgacccagccgggcacctacgatatcgcggccaaaataatgaaggtaagcaataacggcatttaccagttttccatcaacggcgagcctgtcggcgaccccgtcgatatgtattggaacacctccgaatcaacgaagagcttctcgccgggctcctacacattcagcgaaccgggcagctatctgctccgggtgacggtgaccggcaagcatccgagctcgtcgggctacaagctgatgctggatcattttacgctggaggagattcccgtttcgctgcccaatccgtatgaagcggaaacactgccgatccatcatcgcacccagacggtgacgatctacaacgactcgaatacgagcggaggacagcggctgggtctcaatcacaaggttgtcggcgattatacggagtttatactcgacgtgccgcaagcgggcacctacgatatcacggcccgcgtcttgaagttcagcgacaacggcatttatcaattctcgatcgacggcaatcccgtgggcgcgccgattgatacgtattggaatacggcgggttatatccgggatttcacgccgggctcctatacgttcagcgagccggggagctacctgctccgcctgacggcaacagggaaaaatccgagcgcgtcgggtctgaagattatgcttgattacatctggctcgactga

SEQ ID NO: 68 - protein, 1078 aa, Artificial Sequence
  Synthetic Construct
MKKPLGKIVASTALLISVAFSSSIASAHHHHHHPRAEASDMFDELREKYATMLTGGTAYSLSDPDIAARVASITTNAQTLWTSMKKDANRVRLWDNAPLGNDSASITTSYRQLAAMALAYRTYGSSLMGDPDLRDDIIDGLDWINTFQHGFCEGCSMYQNWWHWQIGGPIALNEVIALMYDELTQTQIDSYIAAINYAQPSVNMTGANRLWESQVIALAGINGKNGDKIAHARDGLSALLTYVVQGDGFYEDGSFVQHSYYSYNGGYGLDLLKGIADLTYLLHDSNWEVVDPNKQNIFNWVYDSFEPFIYNGNLMDMVRGREISRHARQSNVVGVEAVAAILRLSHVAPPADAAAFKSMVKHWLQEGGGSQFLQQASITHILSAQDVLNDSGIVPRGELEAYRQFAGMDRALQLRQGYGFGISMFSSRIGGHEAINAENNKGWHTGAGMTYLYNNDLSQFNDHFWPTVNSYRLPGTTVLRDTPQAANTRGDRSWAGGTDMLGLYGITGMEYHAIGKSLTAKKSWFMFDDEIVALGADITSGDGVAVETIVENRKLNGAGDNSLTVNGTAKPATLGWSETMGTTSYAHLGGSVADSDIGYYFPDGGATLHALREARTGNWRQINSAQGSPNAPHTRNYLTMWLEHGVNPSNGAYSYVLLPNKTSAATASYAASPDITIIENSSSAQAVKENGLNMIGVNFWNNERKTAGGITSNAKASVMTRETASELNVSVSDPTQSNVGMIYIEIDKSATGLIAKDDAVTVLQYSPTIKFKVDVNKARGKSFKAAFSLTGAQQPNPAPIPIPNPYEAELLPISATTKTPTLSNDSNASGGKKLGLNSSVVGDYTEFSLDVTQPGTYDIAAKIMKVSNNGIYQFSINGEPVGDPVDMYWNTSESTKSFSPGSYTFSEPGSYLLRVTVTGKHPSSSGYKLMLDHFTLEEIPVSLPNPYEAETLPIHHRTQTVTIYNDSNTSGGQRLGLNHKVVGDYTEFILDVPQAGTYDITARVLKFSDNGIYQFSIDGNPVGAPIDTYWNTAGYIRDFTPGSYTFSEPGSYLLRLTATGKNPSASGLKIMLDYIWLD

SEQ ID NO: 69 - DNA, 41 bp, Artificial Sequence
  Primer D244F
tcaccatcatcctagggcagggaccgtcagcaaaatttccg

SEQ ID NO: 70 - DNA, 41 bp, Artificial Sequence
  Primer D245R
ttattgattaacgcgtttagggtgttgttgcgctaaccgga

SEQ ID NO: 71 - DNA, 41 bp, Artificial Sequence; identical to SEQ ID NO: 69
  Primer D242F

SEQ ID NO: 72 - DNA, 41 bp, Artificial Sequence
  Primer D243R
ttattgattaacgcgtttaagtctggtagaccgctggtccg

SEQ ID NO: 73 - DNA, 41 bp, Artificial Sequence
  Primer D271F
tcaccatcatcctaggaacgcaagcctggttcaaagcgtga

SEQ ID NO: 74 - DNA, 41 bp, Artificial Sequence
  Primer D272R
ttattgattaacgcgtttaaggggtcacggaaacaagctga

SEQ ID NO: 75 - DNA, 41 bp, Artificial Sequence
  Primer D289F
tcaccatcatcctagggcggatgaattcgacgggatgcggg

SEQ ID NO: 76 - DNA, 41 bp, Artificial Sequence
  Primer D290R
ttattgattaacgcgtttacggattacgtacaaatttgact

SEQ ID NO: 77 - DNA, 41 bp, Artificial Sequence
  Primer D293F
tcaccatcatcctagggcggacgagtttgacacgctaaggg

SEQ ID NO: 78 - DNA, 41 bp, Artificial Sequence
  Primer D294R
ttattgattaacgcgtttatgggacctttaccagcttcacg

SEQ ID NO: 79 - DNA, 41 bp, Artificial Sequence; identical to SEQ ID NO: 31
  primer D332F

SEQ ID NO: 80 - DNA, 41 bp, Artificial Sequence
  Primer D333R
ttattgattaacgcgttcagtcgagccagatgtaatcaagc

SEQ ID NO: 81 - DNA, 4227 bp, Paenibacillus sp.
  CDS (1)..(4224)
  sig_peptide (1)..(111)
  mat_peptide (112)..(4224)
atgttattaagcaccttggcccgatccaaaagcaagcggatcgtcgctttatccctgggagtcgcgctcgtccttcccggcgtctctgccgcgccttcggaagtcgcggctgccgtagccccgctccccggcccaagccatccgctcgtgtacgacgacttctccggcggaggcgtcttcaagcagaactggatgaactggtggaaccaggacggcggcaccggcaccttcgcgaaggcgacggaggattcccgcaccgtgggcaaattcgcgcaaacgccggcttcggcgagctcctgggcgaagttccagccctggaacgaaacggttgacgtcaggggataccgctacctcaattttcctctcaaaaatccgggatatcccgacgccaggctccggatcgtcatcaacgacggatcccgcaactacacgctcgcgaactgggtgccggtagacgctggctggacggtcagccagttcgacctggacgcgctctcccccgccatcaacaagaaaaacatcaaattcgaaatctggctcaggcaggcaagcggcgcctatggggaaatctggatggacgacatcaccgccacgacggcctcgagcggcaccgccccggttttgtcggcgacgggcctctcctccaacgccggctccatccataatcagaacacgttgtacaccttctcggccacctacaccgacgcggataacgagaaaccgtacgccatggagctcatcctcgacgactcggcctaccccatgaccgagaagaacgcggccgatacgaattacgccgatggcaaagactacgtctacatgacgaagcttcccgtgggcagccattcgtattacttccgcgcgacggatctgacatccgacggagcttcgacggctttaacgccggggccaaccgtcgtgttctccgagcagacggtagacgtcgtggtcagccaagccggctacagcgccaacgacgtcaaaaacgcgcaagtcgcctccacccagaagctcgtcgacacgtcctacgaagtgctgagcggctcaagcgtcgtcgcttccggcaatatggcgtacgagggcgtcacctggggcaaacacgtctacagcatcgacttctccgcgatctcgaccgtaggaaacggctacactgtcaaaacgaacggcatctcctccttcccgttctccatcgaaacgaacgtgtggaacaactataaggacgagatgacggcattctatcgcctgcttagggctagcgtcccgacgtcggaatcctatcctccgggatacagcaccgtcgcgccgtcggccaagctgtaccatggcgcgggccacttggacgacggggcgtccgcggacggcacggcgcattacgatctgaccggcggctggtacgatgccggcgactacggcaagtacggcggcaaccagtgggtcggcgcccaaatcgcccttgcctacgtccgctatgcggacaaagccagcgtcaagttcgacaacgacggcaacggcgtgcccgacctgatcgacgaagcgatctggggcagcgaatacgtcatcaagttcgccgaccagctcggcggcgcgatgtacaacctgcgcaacaacgcctccttcgtccatccggagaaggcgacggacaatatcgtcggcacggcggacgaccgcaaaatcgtcgactacggcgtcggcggctccgccaaggcggccggcacgctcgcggcaacggcgcgcgcgatccacgcagccatcgcggagggcgacatcgatcccgccaaagtcgcggagctgacggccttcgcggcggaagcggaagcggccgcggtcgtcttttacgaatacgtgctcgaccattataacgatcccatcggctcgtacagcacccgcggcggcatcgacaactccatgctgctggccgacgtcgagctgtatctgctgacgaacgaccaggattacaaggacgcagcgactgccaaaatcaacgcgctcggctttggcgatatttatacgacgaactactgggacatgcggccgatgtcgatggcggagttctatccggtagcggacgcttcgacgcaggcccatattcaggatctgctcaagcagcaggtcgattacttcctctcgtcggccgacgacacgccttaccacgtgctcaaccaattcaagaacttcggcgtcaacgaaccgcatgcttcgtatcttggcgacttgctgcgctactacgagctgttcggggatcccgcggcgctgaacggcgtgctgaaagggctgtattggatcttcggcgccaacccgtggaacatcagctgggtatccggcatcggctccgactacgcggactatccgcatacccgcttcgacgaggaatccaataagccggaaggcaggggcatcgtcttccccggcgccatgctcagcggaccgaacatcaaggatacgaaggacaagaacagcatcagcccttggtaccaagaccgttcgctctatctcgacgacacgaaccaatggcgctacaacgaattcagcgtcagcattcaagccggcctgctctatacgatcatgggccttagcgcgacggacagcgtcgtcgtccctgccggcgctaacccgcagcagctgccgatcctgtcgccgacgatcggcgattccgtccgcggcaacgtgacgatcttcgccggtccggcaaacggcctgacgggcatttcccatacgcagccgagcggcggctgggtgccgatgacggcatcgggagaagcgttcgccggcacggtcgacgaaagcgcggccgcttcgtacgtcaaccgccgcatcgacgtccgcggcacggacgcgctgggcaacgacacgtacagctccactcactacatggtagcggcgccgctgcccgatccttcgacccctctgctctatgacgacatgggcggcggaggcatatggggatcgacgggcggcaacaatcagtgggtgaactggtatacgcagaacggcggcacggctacctttgccaagacgacgctcgacggacgtacggtcggcaagttcacgcagacgccgggctcgacgacgtcgaacgcgaagttccagccatggcatgacgccgtggatctgtccggctaccaatacttgaatttcactgtcaaaaatccgggacatccgaacctgcgcatgaagatcgagctatccgacggcactcgcacgttcaacttgactggcggctgggccagcgtgccgaccgattggacggatctgcagtataatctcgacggcttggcgttccccgtcaacaagaaggccgcgaagctctcgatctggcttaaccagtcgacgggagcctacggcgaaatgtttatcgacgagatcaaagcgaccaacgtagccagcggcacagcgccgacgctgacgggaggaagcgtcgatgtcgcaaccggcgattccgccacggacttcacgttcggcgtgacctacacggatgcggacaatcaggctccgttcacgatggagctggtgctggacggcgtcgtccgcaagatgacggccgccgatccaagcgacaatacctactcggacggcaaggcgtacacgtatacgaccaaacttccgatcggcgtacactcgtattacttccatacgacggataccaaaaccgacgccgtcagcacggccgtggcaacgggccctacggtcggcgacgggccgcagacgctgttctccgacgatttcggcgacggcgacgccgccgggtggacgtcgacgagcggcacgtggaccgtgaccggcggcgcctacaacggcaaagcgggatcgggcaacagctactccgtcgcgggcgattccggctggacggactacgcctttgaggcgaaggttaacgttacgaacaattccggcggcaacaaggatgccggcttgacgttccgctacgccgacgcgaacaactgctacgtcctcttgctcaagaacaacgacaagtccggccgcaaaatggagctggtcaaaatcgtgaacggggtcaaaaccgtgctcgattactccaatcccagcattgcgcccgacacgttgtacacgtataagatcgtcgcagtcggcagccagatcgacgtctataaggacggcgttctggagctaagcgcaactgacggctcccttgccggaggcaaggtcggcgcaagaacctatgctagcacgcttgccgtctacgacgacttcctcgtaacgacgccataa

SEQ ID NO: 82 - protein, 1408 aa, Paenibacillus sp.
MLLSTLARSKSKRIVALSLGVALVLPGVSAAPSEVAAAVAPLPGPSHPLVYDDFSGGGVFKQNWMNWWNQDGGTGTFAKATEDSRTVGKFAQTPASASSWAKFQPWNETVDVRGYRYLNFPLKNPGYPDARLRIVINDGSRNYTLANWVPVDAGWTVSQFDLDALSPAINKKNIKFEIWLRQASGAYGEIWMDDITATTASSGTAPVLSATGLSSNAGSIHNQNTLYTFSATYTDADNEKPYAMELILDDSAYPMTEKNAADTNYADGKDYVYMTKLPVGSHSYYFRATDLTSDGASTALTPGPTVVFSEQTVDVVVSQAGYSANDVKNAQVASTQKLVDTSYEVLSGSSVVASGNMAYEGVTWGKHVYSIDFSAISTVGNGYTVKTNGISSFPFSIETNVWNNYKDEMTAFYRLLRASVPTSESYPPGYSTVAPSAKLYHGAGHLDDGASADGTAHYDLTGGWYDAGDYGKYGGNQWVGAQIALAYVRYADKASVKFDNDGNGVPDLIDEAIWGSEYVIKFADQLGGAMYNLRNNASFVHPEKATDNIVGTADDRKIVDYGVGGSAKAAGTLAATARAIHAAIAEGDIDPAKVAELTAFAAEAEAAAVVFYEYVLDHYNDPIGSYSTRGGIDNSMLLADVELYLLTNDQDYKDAATAKINALGFGDIYTTNYWDMRPMSMAEFYPVADASTQAHIQDLLKQQVDYFLSSADDTPYHVLNQFKNFGVNEPHASYLGDLLRYYELFGDPAALNGVLKGLYWIFGANPWNISWVSGIGSDYADYPHTRFDEESNKPEGRGIVFPGAMLSGPNIKDTKDKNSISPWYQDRSLYLDDTNQWRYNEFSVSIQAGLLYTIMGLSATDSVVVPAGANPQQLPILSPTIGDSVRGNVTIFAGPANGLTGISHTQPSGGWVPMTASGEAFAGTVDESAAASYVNRRIDVRGTDALGNDTYSSTHYMVAAPLPDPSTPLLYDDMGGGGIWGSTGGNNQWVNWYTQNGGTATFAKTTLDGRTVGKFTQTPGSTTSNAKFQPWHDAVDLSGYQYLNFTVKNPGHPNLRMKIELSDGTRTFNLTGGWASVPTDWTDLQYNLDGLAFPVNKKAAKLSIWLNQSTGAYGEMFIDEIKATNVASGTAPTLTGGSVDVATGDSATDFTFGVTYTDADNQAPFTMELVLDGVVRKMTAADPSDNTYSDGKAYTYTTKLPIGVHSYYFHTTDTKTDAVSTAVATGPTVGDGPQTLFSDDFGDGDAAGWTSTSGTWTVTGGAYNGKAGSGNSYSVAGDSGWTDYAFEAKVNVTNNSGGNKDAGLTFRYADANNCYVLLLKNNDKSGRKMELVKIVNGVKTVLDYSNPSIAPDTLYTYKIVAVGSQIDVYKDGVLELSATDGSLAGGKVGARTYASTLAVYDDFLVTTP

SEQ ID NO: 83 - DNA, 4221 bp, Artificial Sequence
  Synthetic construct
  CDS (1)..(4218)
  sig_peptide (1)..(81)
  mat_peptide (82)..(4218)
atgaagaaaccgttggggaaaattgtcgcaagcaccgcactactcatttctgttgcttttagttcatcgatagcatcagcacatcatcatcaccatcatcctagggccgtagccccgctccccggcccaagccatccgctcgtgtacgacgacttctccggcggaggcgtcttcaagcagaactggatgaactggtggaaccaggacggcggcaccggcaccttcgcgaaggcgacggaggattcccgcaccgtgggcaaattcgcgcaaacgccggcttcggcgagctcctgggcgaagttccagccctggaacgaaacggttgacgtcaggggataccgctacctcaattttcctctcaaaaatccgggatatcccgacgccaggctccggatcgtcatcaacgacggatcccgcaactacacgctcgcgaactgggtgccggtagacgctggctggacggtcagccagttcgacctggacgcgctctcccccgccatcaacaagaaaaacatcaaattcgaaatctggctcaggcaggcaagcggcgcctatggggaaatctggatggacgacatcaccgccacgacggcctcgagcggcaccgccccggttttgtcggcgacgggcctctcctccaacgccggctccatccataatcagaacacgttgtacaccttctcggccacctacaccgacgcggataacgagaaaccgtacgccatggagctcatcctcgacgactcggcctaccccatgaccgagaagaacgcggccgatacgaattacgccgatggcaaagactacgtctacatgacgaagcttcccgtgggcagccattcgtattacttccgcgcgacggatctgacatccgacggagcttcgacggctttaacgccggggccaaccgtcgtgttctccgagcagacggtagacgtcgtggtcagccaagccggctacagcgccaacgacgtcaaaaacgcgcaagtcgcctccacccagaagctcgtcgacacgtcctacgaagtgctgagcggctcaagcgtcgtcgcttccggcaatatggcgtacgagggcgtcacctggggcaaacacgtctacagcatcgacttctccgcgatctcgaccgtaggaaacggctacactgtcaaaacgaacggcatctcctccttcccgttctccatcgaaacgaacgtgtggaacaactataaggacgagatgacggcattctatcgcctgcttagggctagcgtcccgacgtcggaatcctatcctccgggatacagcaccgtcgcgccgtcggccaagctgtaccatggcgcgggccacttggacgacggggcgtccgcggacggcacggcgcattacgatctgaccggcggctggtacgatgccggcgactacggcaagtacggcggcaaccagtgggtcggcgcccaaatcgcccttgcctacgtccgctatgcggacaaagccagcgtcaagttcgacaacgacggcaacggcgtgcccgacctgatcgacgaagcgatctggggcagcgaatacgtcatcaagttcgccgaccagctcggcggcgcgatgtacaacctgcgcaacaacgcctccttcgtccatccggagaaggcgacggacaatatcgtcggcacggcggacgaccgcaaaatcgtcgactacggcgtcggcggctccgccaaggcggccggcacgctcgcggcaacggcgcgcgcgatccacgcagccatcgcggagggcgacatcgatcccgccaaagtcgcggagctgacggccttcgcggcggaagcggaagcggccgcggtcgtcttttacgaatacgtgctcgaccattataacgatcccatcggctcgtacagcacccgcggcggcatcgacaactccatgctgctggccgacgtcgagctgtatctgctgacgaacgaccaggattacaaggacgcagcgactgccaaaatcaacgcgctcggctttggcgatatttatacgacgaactactgggacatgcggccgatgtcgatggcggagttctatccggtagcggacgcttcgacgcaggcccatattcaggatctgctcaagcagcaggtcgattacttcctctcgtcggccgacgacacgccttaccacgtgctcaaccaattcaagaacttcggcgtcaacgaaccgcatgcttcgtatcttggcgacttgctgcgctactacgagctgttcggggatcccgcggcgctgaacggcgtgctgaaagggctgtattggatcttcggcgccaacccgtggaacatcagctgggtatccggcatcggctccgactacgcggactatccgcatacccgcttcgacgaggaatccaataagccggaaggcaggggcatcgtcttccccggcgccatgctcagcggaccgaacatcaaggatacgaaggacaagaacagcatcagcccttggtaccaagaccgttcgctctatctcgacgacacgaaccaatggcgctacaacgaattcagcgtcagcattcaagccggcctgctctatacgatcatgggccttagcgcgacggacagcgtcgtcgtccctgccggcgctaacccgcagcagctgccgatcctgtcgccgacgatcggcgattccgtccgcggcaacgtgacgatcttcgccggtccggcaaacggcctgacgggcatttcccatacgcagccgagcggcggctgggtgccgatgacggcatcgggagaagcgttcgccggcacggtcgacgaaagcgcggccgcttcgtacgtcaaccgccgcatcgacgtccgcggcacggacgcgctgggcaacgacacgtacagctccactcactacatggtagcggcgccgctgcccgatccttcgacccctctgctctatgacgacatgggcggcggaggcatatggggatcgacgggcggcaacaatcagtgggtgaactggtatacgcagaacggcggcacggctacctttgccaagacgacgctcgacggacgtacggtcggcaagttcacgcagacgccgggctcgacgacgtcgaacgcgaagttccagccatggcatgacgccgtggatctgtccggctaccaatacttgaatttcactgtcaaaaatccgggacatccgaacctgcgcatgaagatcgagctatccgacggcactcgcacgttcaacttgactggcggctgggccagcgtgccgaccgattggacggatctgcagtataatctcgacggcttggcgttccccgtcaacaagaaggccgcgaagctctcgatctggcttaaccagtcgacgggagcctacggcgaaatgtttatcgacgagatcaaagcgaccaacgtagccagcggcacagcgccgacgctgacgggaggaagcgtcgatgtcgcaaccggcgattccgccacggacttcacgttcggcgtgacctacacggatgcggacaatcaggctccgttcacgatggagctggtgctggacggcgtcgtccgcaagatgacggccgccgatccaagcgacaatacctactcggacggcaaggcgtacacgtatacgaccaaacttccgatcggcgtacactcgtattacttccatacgacggataccaaaaccgacgccgtcagcacggccgtggcaacgggccctacggtcggcgacgggccgcagacgctgttctccgacgatttcggcgacggcgacgccgccgggtggacgtcgacgagcggcacgtggaccgtgaccggcggcgcctacaacggcaaagcgggatcgggcaacagctactccgtcgcgggcgattccggctggacggactacgcctttgaggcgaaggttaacgttacgaacaattccggcggcaacaaggatgccggcttgacgttccgctacgccgacgcgaacaactgctacgtcctcttgctcaagaacaacgacaagtccggccgcaaaatggagctggtcaaaatcgtgaacggggtcaaaaccgtgctcgattactccaatcccagcattgcgcccgacacgttgtacacgtataagatcgtcgcagtcggcagccagatcgacgtctataaggacggcgttctggagctaagcgcaactgacggctcccttgccggaggcaaggtcggcgcaagaacctatgctagcacgcttgccgtctacgacgacttcctcgtaacgacgccataa

SEQ ID NO: 84 - protein, 1406 aa, Artificial Sequence
  Synthetic Construct
MKKPLGKIVASTALLISVAFSSSIASAHHHHHHPRAVAPLPGPSHPLVYDDFSGGGVFKQNWMNWWNQDGGTGTFAKATEDSRTVGKFAQTPASASSWAKFQPWNETVDVRGYRYLNFPLKNPGYPDARLRIVINDGSRNYTLANWVPVDAGWTVSQFDLDALSPAINKKNIKFEIWLRQASGAYGEIWMDDITATTASSGTAPVLSATGLSSNAGSIHNQNTLYTFSATYTDADNEKPYAMELILDDSAYPMTEKNAADTNYADGKDYVYMTKLPVGSHSYYFRATDLTSDGASTALTPGPTVVFSEQTVDVVVSQAGYSANDVKNAQVASTQKLVDTSYEVLSGSSVVASGNMAYEGVTWGKHVYSIDFSAISTVGNGYTVKTNGISSFPFSIETNVWNNYKDEMTAFYRLLRASVPTSESYPPGYSTVAPSAKLYHGAGHLDDGASADGTAHYDLTGGWYDAGDYGKYGGNQWVGAQIALAYVRYADKASVKFDNDGNGVPDLIDEAIWGSEYVIKFADQLGGAMYNLRNNASFVHPEKATDNIVGTADDRKIVDYGVGGSAKAAGTLAATARAIHAAIAEGDIDPAKVAELTAFAAEAEAAAVVFYEYVLDHYNDPIGSYSTRGGIDNSMLLADVELYLLTNDQDYKDAATAKINALGFGDIYTTNYWDMRPMSMAEFYPVADASTQAHIQDLLKQQVDYFLSSADDTPYHVLNQFKNFGVNEPHASYLGDLLRYYELFGDPAALNGVLKGLYWIFGANPWNISWVSGIGSDYADYPHTRFDEESNKPEGRGIVFPGAMLSGPNIKDTKDKNSISPWYQDRSLYLDDTNQWRYNEFSVSIQAGLLYTIMGLSATDSVVVPAGANPQQLPILSPTIGDSVRGNVTIFAGPANGLTGISHTQPSGGWVPMTASGEAFAGTVDESAAASYVNRRIDVRGTDALGNDTYSSTHYMVAAPLPDPSTPLLYDDMGGGGIWGSTGGNNQWVNWYTQNGGTATFAKTTLDGRTVGKFTQTPGSTTSNAKFQPWHDAVDLSGYQYLNFTVKNPGHPNLRMKIELSDGTRTFNLTGGWASVPTDWTDLQYNLDGLAFPVNKKAAKLSIWLNQSTGAYGEMFIDEIKATNVASGTAPTLTGGSVDVATGDSATDFTFGVTYTDADNQAPFTMELVLDGVVRKMTAADPSDNTYSDGKAYTYTTKLPIGVHSYYFHTTDTKTDAVSTAVATGPTVGDGPQTLFSDDFGDGDAAGWTSTSGTWTVTGGAYNGKAGSGNSYSVAGDSGWTDYAFEAKVNVTNNSGGNKDAGLTFRYADANNCYVLLLKNNDKSGRKMELVKIVNGVKTVLDYSNPSIAPDTLYTYKIVAVGSQIDVYKDGVLELSATDGSLAGGKVGARTYASTLAVYDDFLVTTP

SEQ ID NO: 85 - DNA, 3723 bp, Paenibacillus sp
  CDS (1)..(3720)
  sig_peptide (1)..(111)
  mat_peptide (112)..(3720)
atgattgccaaaaaaggtttgaaaacccgcatgcagcaagtcttattgacagggctggggctcgtgctggccttgaatgtcttttttttgccgcctcgtactgttcaggccgctccggctccgctgccgggaccgagcaaccctttgatttacgacgacttcgcgggcggaggcgtgttcaagcaaaattggatgaactggtggaatcaggacgggggtgtaggcaccttctccaaaacgacggaggacggccgctcgatcggcgtatttgcgcaaactccggcatcgagctcgtcgtgggccaaatttcagccatggaatgaaaccgtcaacttgacggggtatcgctacattaatgtcagcctgaaaaatcccggttatgagaacgccctgatgcgcattctgatcaacgacggctcgcgcaatatactgattacggaaggatgggcgccggttccggacgactggacaacgctgcagttggacctggacgcgctggagcctgcagtcaacaaacggaatatcaaatttgaaatctggctgcgccagacgggcgggagctacggcgaaatctgggtggacgacattaccgccacaacggcttcatccggcaccgcgccgacgctgaccgcaaccggcgtaaccgccaacaccgacggcgcctacaatcaaaatacggtattcaccttcgctgcaacctacacggacgccgataatgaagctccgttcgccatgcaggtcatcattgatgatctggtctacgacatgcgggagatcgattacggagatacgacttatacggacggcaaagcgtatacctattcaaccaagctgtctcccggctcccactcctactacttccgcgcaaccgatctgacctcggacggcgccgagacgacgctgcagtcgggccttaacgtcatttactcggagcagatcattgatgtcgtcgtcagccaggcgggctacagcgccggcgactacaaaaatgccaaggttgtatcgtcgcttcctctgaccaatacctcttatgaggtgctggacggatcgagcacgctcgtcgcgtctggcgacctcatctacgagggcattacctggaacaaacatgtctatgcgatcgacttcagctccgtcacctcgaccggaaacgcttttacgatcaagagcaacggcatttcctcttatccattccctattcagtcgaatatatgggacagctataaggatgaaatgacggcattctaccgtatccaacgcgccggcgtggccacctcggaggcctatcctcccggctacagcagcatagcgccttccgccaaagtctatcatccggcggggcatctggacgatgcggtctccgctgacggcacccagcaatacgatttggtcggcggctggtacgatgcgggcgattacggccaatacggcggcaatcagtgggtcggcgcccagatcgccctcgcctatattcgatacgccgagcataacagcgtgaaatacgacaatgacggcaacggcattcccgatctggtcgacgaagcgatattcggcagcgaatatttgatcaaattcgcgaatcagcttggcgggcagatgttcaatctgcggaataacgcctcgttcattcatccgcataaggcgactgataatattccgggcacggccgatgaccgcaagctggtcgatccgggcgttggcggctccgccaaatcggccggtacgctggccgcaaccgcgcgggcgatctatgccgccatcgccgaaggcgatatcgatccggcgaagatcgtcgagcttgaggcgtttgccgccgaatgcgaagcggccgctgttattttctacgactatgcggcggcccatccgaatgatcccgtcggcagctacacgaccagaggcggccttccgaactccatgctgcttgcggaggttcagctgtacctgctgacggacgacagcgattacagagatgccgccgtaacgcagatcaacggtcttgcgtttgaggatctgtttgcaaccaactattgggatatgcgtccgatgtcgatggcggaactttatccgcatgtcgacccggccacgcaagcgcatattcagctgttgctcaagcagcaggtggatttcttcctctcctcgacggacgatacgccgtacggcgtgcttaaccagttcaaaaacttcggcgtcaacgagccgcatgtttcctatttgggagatttgctgcgctactatgagctgtttggcgatccggccgccctgcgcgcggtgctgaagggcatgtactgggttttcggcgaaaatccgtggaatatcagctgggtatccggcattggcgcgaatcatgtcaagtttttgcatacccgtctggatgagcaggcaaactcgccgaccgccacaggcattgtcattcccggcgcgatggtgagcggaccgaatatgaaggatacgaaaaacaaaaaaagcgtcagtccgtggtacgaggatcgctcgctctatcaggatgacgtcaatcaatggcggtacaatgaatacagcgtcagtatccaggtcggcctgctgtacacgattatgggcctcagcacgctggataacgccagctccgaaggcggcgtctatccggtcgaactgccgattctgtcgccgactatcggggattacgtccgcggtcaggtgactgtgctcgccgctccggcgccggggcttgtcgccatggacttttcgtccggcggagcgtacagcgcgatgaccccttcgggcacagcctacgccgcgacgatcgacgaaagcgcatctaacccttacgcgaatcggagaattgatgtgagaggcatcgacgccgcgggcaaccgcacctacagctcgacccattatacggtggcgcagccgctgcccgatccttccactccgcttctctatgacgacttcggaggcaacggattatggggcgcggcaggcggcaacaactcatgggtcaactggtatacgcaaaacggcggcagcgccacctttgccagaacgaccgaggacggccgcacggtcggcaagtttacgcagacgccgtcctccggcacatccaatgccaaattccagccttggcatgatgtcgtcgatttgtccggctatcgctatgttaactttacagtgaaaaatggcggctatcccgacctgaggatgcggatcgaaatgtcggacggcaatcgtacgtacaatttaaccggcggctgggcaagcgttccgaacgactggaccgagcttcaattcgatctcgacgcgctcgtgcctgccgcgaacaaagctgcggcgcgcttctccgtctggctgaatcagtccgggggcagctacggcgaaatgttcatcgacgaaatcaaggcggttaatgtcgcgagcggcaacgcgcctacgctgacgggcgccggcgtcgatctgtcggcgggagatacggaaacggaatttacgttcaacgtcacctacacggatgcggacaatgaagcgccgtttgcgctggagtttgtgctgaacggcgtcatccatcacatggagccggtcgatccgggagatacgacttactcggacggcaaggattacgcatacacaacacgtttgccgattggcatccattcgtattacttccacacgaccgacacttcgtccgatgcggtcagcaccgccgttctggcaggtccgaccgtcacggccgctgcccaaacactgttcttcgacgac

SEQ ID NO: 86 - protein, 1240 aa, Paenibacillus sp
MIAKKGLKTRMQQVLLTGLGLVLALNVFFLPPRTVQAAPAPLPGPSNPLIYDDFAGGGVFKQNWMNWWNQDGGVGTFSKTTEDGRSIGVFAQTPASSSSWAKFQPWNETVNLTGYRYINVSLKNPGYENALMRILINDGSRNILITEGWAPVPDDWTTLQLDLDALEPAVNKRNIKFEIWLRQTGGSYGEIWVDDITATTASSGTAPTLTATGVTANTDGAYNQNTVFTFAATYTDADNEAPFAMQVIIDDLVYDMREIDYGDTTYTDGKAYTYSTKLSPGSHSYYFRATDLTSDGAETTLQSGLNVIYSEQIIDVVVSQAGYSAGDYKNAKVVSSLPLTNTSYEVLDGSSTLVASGDLIYEGITWNKHVYAIDFSSVTSTGNAFTIKSNGISSYPFPIQSNIWDSYKDEMTAFYRIQRAGVATSEAYPPGYSSIAPSAKVYHPAGHLDDAVSADGTQQYDLVGGWYDAGDYGQYGGNQWVGAQIALAYIRYAEHNSVKYDNDGNGIPDLVDEAIFGSEYLIKFANQLGGQMFNLRNNASFIHPHKATDNIPGTADDRKLVDPGVGGSAKSAGTLAATARAIYAAIAEGDIDPAKIVELEAFAAECEAAAVIFYDYAAAHPNDPVGSYTTRGGLPNSMLLAEVQLYLLTDDSDYRDAAVTQINGLAFEDLFATNYWDMRPMSMAELYPHVDPATQAHIQLLLKQQVDFFLSSTDDTPYGVLNQFKNFGVNEPHVSYLGDLLRYYELFGDPAALRAVLKGMYWVFGENPWNISWVSGIGANHVKFLHTRLDEQANSPTATGIVIPGAMVSGPNMKDTKNKKSVSPWYEDRSLYQDDVNQWRYNEYSVSIQVGLLYTIMGLSTLDNASSEGGVYPVELPILSPTIGDYVRGQVTVLAAPAPGLVAMDFSSGGAYSAMTPSGTAYAATIDESASNPYANRRIDVRGIDAAGNRTYSSTHYTVAQPLPDPSTPLLYDDFGGNGLWGAAGGNNSWVNWYTQNGGSATFARTTEDGRTVGKFTQTPSSGTSNAKFQPWHDVVDLSGYRYVNFTVKNGGYPDLRMRIEMSDGNRTYNLTGGWASVPNDWTELQFDLDALVPAANKAAARFSVWLNQSGGSYGEMFIDEIKAVNVASGNAPTLTGAGVDLSAGDTETEFTFNVTYTDADNEAPFALEFVLNGVIHHMEPVDPGDTTYSDGKDYAYTTRLPIGIHSYYFHTTDTSSDAVSTAVLAGPTVTAAAQTLFFD

SEQ ID NO: 87 - DNA, 3714 bp, Artificial Sequence
  Synthetic construct
  CDS (1)..(3711)
  sig_peptide (1)..(81)
  mat_peptide (82)..(3711)
atgaaaaaaccgctggggaaaattgtcgcaagcaccgcactactcatttctgttgcttttagttcatcgatcgcatcggctgctccggctccgctgccgggaccgagcaaccctttgatttacgacgacttcgcgggcggaggcgtgttcaagcaaaattggatgaactggtggaatcaggacgggggtgtaggcaccttctccaaaacgacggaggacggccgctcgatcggcgtatttgcgcaaactccggcatcgagctcgtcgtgggccaaatttcagccatggaatgaaaccgtcaacttgacggggtatcgctacattaatgtcagcctgaaaaatcccggttatgagaacgccctgatgcgcattctgatcaacgacggctcgcgcaatatactgattacggaaggatgggcgccggttccggacgactggacaacgctgcagttggacctggacgcgctggagcctgcagtcaacaaacggaatatcaaatttgaaatctggctgcgccagacgggcgggagctacggcgaaatctgggtggacgacattaccgccacaacggcttcatccggcaccgcgccgacgctgaccgcaaccggcgtaaccgccaacaccgacggcgcctacaatcaaaatacggtattcaccttcgctgcaacctacacggacgccgataatgaagctccgttcgccatgcaggtcatcattgatgatctggtctacgacatgcgggagatcgattacggagatacgacttatacggacggcaaagcgtatacctattcaaccaagctgtctcccggctcccactcctactacttccgcgcaaccgatctgacctcggacggcgccgagacgacgctgcagtcgggccttaacgtcatttactcggagcagatcattgatgtcgtcgtcagccaggcgggctacagcgccggcgactacaaaaatgccaaggttgtatcgtcgcttcctctgaccaatacctcttatgaggtgctggacggatcgagcacgctcgtcgcgtctggcgacctcatctacgagggcattacctggaacaaacatgtctatgcgatcgacttcagctccgtcacctcgaccggaaacgcttttacgatcaagagcaacggcatttcctcttatccattccctattcagtcgaatatatgggacagctataaggatgaaatgacggcattctaccgtatccaacgcgccggcgtggccacctcggaggcctatcctcccggctacagcagcatagcgccttccgccaaagtctatcatccggcggggcatctggacgatgcggtctccgctgacggcacccagcaatacgatttggtcggcggctggtacgatgcgggcgattacggccaatacggcggcaatcagtgggtcggcgcccagatcgccctcgcctatattcgatacgccgagcataacagcgtgaaatacgacaatgacggcaacggcattcccgatctggtcgacgaagcgatattcggcagcgaatatttgatcaaattcgcgaatcagcttggcgggcagatgttcaatctgcggaataacgcctcgttcattcatccgcataaggcgactgataatattccgggcacggccgatgaccgcaagctggtcgatccgggcgttggcggctccgccaaatcggccggtacgctggccgcaaccgcgcgggcgatctatgccgccatcgccgaaggcgatatcgatccggcgaagatcgtcgagcttgaggcgtttgccgccgaatgcgaagcggccgctgttattttctacgactatgcggcggcccatccgaatgatcccgtcggcagctacacgaccagaggcggccttccgaactccatgctgcttgcggaggttcagctgtacctgctgacggacgacagcgattacagagatgccgccgtaacgcagatcaacggtcttgcgtttgaggatctgtttgcaaccaactattgggatatgcgtccgatgtcgatggcggaactttatccgcatgtcgacccggccacgcaagcgcatattcagctgttgctcaagcagcaggtggatttcttcctctcctcgacggacgatacgccgtacggcgtgcttaaccagttcaaaaacttcggcgtcaacgagccgcatgtttcctatttgggagatttgctgcgctactatgagctgtttggcgatccggccgccctgcgcgcggtgctgaagggcatgtactgggttttcggcgaaaatccgtggaatatcagctgggtatccggcattggcgcgaatcatgtcaagtttttgcatacccgtctggatgagcaggcaaactcgccgaccgccacaggcattgtcattcccggcgcgatggtgagcggaccgaatatgaaggatacgaaaaacaaaaaaagcgtcagtccgtggtacgaggatcgctcgctctatcaggatgacgtcaatcaatggcggtacaatgaatacagcgtcagtatccaggtcggcctgctgtacacgattatgggcctcagcacgctggataacgccagctccgaaggcggcgtctatccggtcgaactgccgattctgtcgccgactatcggggattacgtccgcggtcaggtgactgtgctcgccgctccggcgccggggcttgtcgccatggacttttcgtccggcggagcgtacagcgcgatgaccccttcgggcacagcctacgccgcgacgatcgacgaaagcgcatctaacccttacgcgaatcggagaattgatgtgagaggcatcgacgccgcgggcaaccgcacctacagctcgacccattatacggtggcgcagccgctgcccgatccttccactccgcttctctatgacgacttcggaggcaacggattatggggcgcggcaggcggcaacaactcatgggtcaactggtatacgcaaaacggcggcagcgccacctttgccagaacgaccgaggacggccgcacggtcggcaagtttacgcagacgccgtcctccggcacatccaatgccaaattccagccttggcatgatgtcgtcgatttgtccggctatcgctatgttaactttacagtgaaaaatggcggctatcccgacctgaggatgcggatcgaaatgtcggacggcaatcgtacgtacaatttaaccggcggctgggcaagcgttccgaacgactggaccgagcttcaattcgatctcgacgcgctcgtgcctgccgcgaacaaagctgcggcgcgcttctccgtctggctgaatcagtccgggggcagctacggcgaaatgttcatcgacgaaatcaaggcggttaatgtcgcgagcggcaacgcgcctacgctgacgggcgccggcgtcgatctgtcggcgggagatacggaaacggaatttacgttcaacgtcacctacacggatgcggacaatgaagcgccgtttgcgctggagtttgtgctgaacggcgtcatccatcacatggagccggtcgatccgggagatacgacttactcggacggcaaggattacgcatacacaacacgtttgccgattggcatccattcgtattacttccacacgaccgacacttcgtccgatgcggtcagcaccgccgttctggcaggtccgaccgtcacggccgctgcccaaacactgttcttcgacgaccatcatcaccatcaccactaa

SEQ ID NO: 88 - protein, 1237 aa, Artificial Sequence
  Synthetic Construct
MKKPLGKIVASTALLISVAFSSSIASAAPAPLPGPSNPLIYDDFAGGGVFKQNWMNWWNQDGGVGTFSKTTEDGRSIGVFAQTPASSSSWAKFQPWNETVNLTGYRYINVSLKNPGYENALMRILINDGSRNILITEGWAPVPDDWTTLQLDLDALEPAVNKRNIKFEIWLRQTGGSYGEIWVDDITATTASSGTAPTLTATGVTANTDGAYNQNTVFTFAATYTDADNEAPFAMQVIIDDLVYDMREIDYGDTTYTDGKAYTYSTKLSPGSHSYYFRATDLTSDGAETTLQSGLNVIYSEQIIDVVVSQAGYSAGDYKNAKVVSSLPLTNTSYEVLDGSSTLVASGDLIYEGITWNKHVYAIDFSSVTSTGNAFTIKSNGISSYPFPIQSNIWDSYKDEMTAFYRIQRAGVATSEAYPPGYSSIAPSAKVYHPAGHLDDAVSADGTQQYDLVGGWYDAGDYGQYGGNQWVGAQIALAYIRYAEHNSVKYDNDGNGIPDLVDEAIFGSEYLIKFANQLGGQMFNLRNNASFIHPHKATDNIPGTADDRKLVDPGVGGSAKSAGTLAATARAIYAAIAEGDIDPAKIVELEAFAAECEAAAVIFYDYAAAHPNDPVGSYTTRGGLPNSMLLAEVQLYLLTDDSDYRDAAVTQINGLAFEDLFATNYWDMRPMSMAELYPHVDPATQAHIQLLLKQQVDFFLSSTDDTPYGVLNQFKNFGVNEPHVSYLGDLLRYYELFGDPAALRAVLKGMYWVFGENPWNISWVSGIGANHVKFLHTRLDEQANSPTATGIVIPGAMVSGPNMKDTKNKKSVSPWYEDRSLYQDDVNQWRYNEYSVSIQVGLLYTIMGLSTLDNASSEGGVYPVELPILSPTIGDYVRGQVTVLAAPAPGLVAMDFSSGGAYSAMTPSGTAYAATIDESASNPYANRRIDVRGIDAAGNRTYSSTHYTVAQPLPDPSTPLLYDDFGGNGLWGAAGGNNSWVNWYTQNGGSATFARTTEDGRTVGKFTQTPSSGTSNAKFQPWHDVVDLSGYRYVNFTVKNGGYPDLRMRIEMSDGNRTYNLTGGWASVPNDWTELQFDLDALVPAANKAAARFSVWLNQSGGSYGEMFIDEIKAVNVASGNAPTLTGAGVDLSAGDTETEFTFNVTYTDADNEAPFALEFVLNGVIHHMEPVDPGDTTYSDGKDYAYTTRLPIGIHSYYFHTTDTSSDAVSTAVLAGPTVTAAAQTLFFDDHHHHHH

SEQ ID NO: 89 - DNA, 4251 bp, Paenibacillus sp
  CDS (1)..(4248)
  sig_peptide (1)..(111)
  mat_peptide (112)..(4248)
atgttgacgtgtatctccggatggaccggagcccggcggatgctctgcgcaggactcggtgtcctgctgctcctgcaggcgttcgcgctctcccccgcccctgccgctgcggccactccccccttgcccgggccgggcacgcccctgatctatgatgatttcggtggcggcggcgtgttcaagcagaattggatgaattggtacaaccaggccggcggcaccggcacgttctcgcgcacgaccgtggacggacgcagcgttggcgtgttcgcccagacgcccgccaccgcttcatcctgggccaagttccagccctggaacgaggaagtcgacctctcgggttaccgttatgtcaacgctacggtgcgcaatcccgactaccccgatgcccgtctgcgcattgcggtacaggacggcacccgcagcgtcaacctcaccgacggctgggtcgccgtggatgaggactggacaacactgacgctcgatctggacgcactctcccccgctttggacaagaagaagattcgcttcgagatctggctgcgtcagactggcggtgcgtatggcgagattctcgtggacgagctcaccgccaccaccgcgcagagcggctccgcgccgatcctctcgaattacggcgtcaccgccaacaccagcggcgcctacacgcagaacacgatctttaccttccgtgccacatacactgatgcggacaacgaacagccttttgccatgcaagtcatcatcaatgacaccccctacgccatgcgggaagtggatcccggcgatctggactataccgacggcaaggcctatacctacacaacacagctgccgccaggcggacatgcctattccttccgcaccaccgatactacctctgacggcgatcagaccgccgtgcagcctggcctcaccgtcagtcttgccgagcaagcaattgatgtggtcgtcagccaggctggctacagtgccagcgacctcaagacagcacaagttgtcgcggtacaaccgctcagcgacttgagctatgaagtgcacagcggcggctcggccgtccataccggcacactgtcttatgagggggttgtctgggacaagcacgtatacaccgctgacttctcgacattcactgccgcgagcggcagctttacagtcgtcagtaacgacatctcctcctacccctttcccatccagaccaacgtctgggacaactacagagatgagatgaccgccttttatcgcctcctgcgcgccggcgttgccacggaggatgcttatccggcaggctacagtacagcagcgccctcagccaagctgtaccatccggccggtcatctcgacgacgcggcttctgccgacggctcacagcagtacgacttgaccggcagctggtacgacgctggcgactatggcaagtacggcggcaatcaatgggtcggcgcccagatcgcgctgtcgtacattcgccatgctgatcaaacggctgtcaaatatgacctagatggcaatggcattcccgatctgatcgacgaggccgtgttcggcagcgaatatctgatcaagttcgccgaccaactgggcggcgcgatgtacaatctgcgcaacaacgccagcttcgtgcatccgcacaaagccaccgacaacatccccggcaccgctgacgaccggcgcctgaccgatctcggcgttggcggctctgccaaatcctcagggacgctcgctgctacggcgcgggcgatccgtatcgccatcgccaacggcgatatccctgccagccaggcgacagaactggaggcgtttgcccaggccagcgaggatgcggcactggtattctataattacgtactcgccaatccgaccgctcccattggcagctacagcacgcatggcggcatcgccaactcacggctgctcgccgaggtgcagctgtatctgctgaccggcgacaccgattaccgggatgccgccgcagcccagattaacagcctgactctggccgatctgtcttcgacgaactactgggacatgcggccgatgtcgatggctgagctgtatccgcaagccgacagtgccacccaggcccacatccaggacttgctcaagcagcaggtcgactacttcctctcgcttgctgacgatacgccatacggcgtgctgaaccgcttcggcaacttcggcgtgaatgagccccatgtctcgtatctcggcgacctgatgcgctactacgagctgttcggtgacgagaccgtgctcgaagccattcaacgcgggctgtattgggtgtttggccaaaatccatggaatatcagctgggtgtcgggtatcggcaccgactacacccgcttccttcatacacgttttgatgaagaagcaaactccgctgccggccaaggtattgtccttcccggcgccatggttagcggacccaacatgaaagatccgacgaaccggcagagcgtcagtccttggtacgacgaccgttcgctgcataccgacagtattaaccactggcgctacaacgagttcagcatcagcatccaggccggactgttgtacacgattatggcgctgagcgcagctgacaccccggcttcggcaccaggtacgccgccgactgcgctgccgatcctctcgccttcctttggcgactatgtgcggggccaagtcaccgttcaggtgcctgccattgccggtctgagtgacttcgccttctttacgccaggctcggcttacaccccaatgacgctggagggcgatgtctataccgcagtgatcgacgaatcagcgaccgccgcctacaccaacaaacgtgtcgaggtccgggccgtagacagcgctggcagcttcacctacagctctgtgcaatacactgtcgcaccgccgctgcctgcccccgcctcgccactcgtctatgacgacatgggcggcggcggctggtggggtgcggttggcggcaataatcaatgggtcaactggtatacgcaaaatggcggcaccgctaccttcgccaaggagaacgtggacggccggacagtcggtcgcttcacacaaacaccgggctccgcgacctcagccgcgaagttccagccttggcatgataccgccgacctctcgggttaccgctatattcgattcacagccaaaaatccggggtacgccgacctccgtatgcgtgtcgaactgtcggacggtacccgcacgcacaacctgacgggcggttggataccggtacccgagacttggacagaactgcaattcgacctgaatacgctggcacatccggtcaataagaagacctccaagctgtccgtctggctgaatcagtcgaccggcagctacggcgagctgctcgtagatgacatccgggcggtcaacacagctaccggaagtgcgcctgtgctgactgacggcacagtgacaccagctagcggcggcgaagaaaccgactttaccttcgcagtcacctacaccgatgccgacaatgaagcgccttacgccgtagaactgaacgtgggcggcgttctgcaccggatgagcgccgtcgatccggccgacaccaactacaccgacggcaagagctatgctgtaacagcgaagctgccgcagggtacgcacacgtatgctttccagacaacggataccacctcggaggccgtcgtcacgctcccggccagcttgtctgtcagcgctagcggggacagcgagcccgaaccgggatctgatcctggagtactgttcaccgatgacttcagtgacgaggccagcgcgtggacgacaaccagcggcacctggagcattcaggacggcgcctatgtcggccaggcaagcagcgggacctcgctagctcttgccggggacagcacctggagtgattacacgtatgaagcccgcgtcagcatcaccaacaattccgggggcaacaaggacgcggggctggtattccgtcacaccgatatggacaacgggtacatcctctacctcaagaacaacgaccgcagcggccgcaagctggagctgatccgcaacgttggcggtgtccggacgacactggcctttgctaacccgagcatcgctgcggacaccttctatacgtacaaaatcgtactcgaaggcgactccatcgaggtgtaccaggacgatgtgctccaactgagcactacggacaacacccatagcaccggcgccattggcctgcgggtctacgccaataccaaagcgctctttgacgacgtagtggtaaccgactga

SEQ ID NO: 90 - protein, 1416 aa, Paenibacillus sp
MLTCISGWTGARRMLCAGLGVLLLLQAFALSPAPAAAATPPLPGPGTPLIYDDFGGGGVFKQNWMNWYNQAGGTGTFSRTTVDGRSVGVFAQTPATASSWAKFQPWNEEVDLSGYRYVNATVRNPDYPDARLRIAVQDGTRSVNLTDGWVAVDEDWTTLTLDLDALSPALDKKKIRFEIWLRQTGGAYGEILVDELTATTAQSGSAPILSNYGVTANTSGAYTQNTIFTFRATYTDADNEQPFAMQVIINDTPYAMREVDPGDLDYTDGKAYTYTTQLPPGGHAYSFRTTDTTSDGDQTAVQPGLTVSLAEQAIDVVVSQAGYSASDLKTAQVVAVQPLSDLSYEVHSGGSAVHTGTLSYEGVVWDKHVYTADFSTFTAASGSFTVVSNDISSYPFPIQTNVWDNYRDEMTAFYRLLRAGVATEDAYPAGYSTAAPSAKLYHPAGHLDDAASADGSQQYDLTGSWYDAGDYGKYGGNQWVGAQIALSYIRHADQTAVKYDLDGNGIPDLIDEAVFGSEYLIKFADQLGGAMYNLRNNASFVHPHKATDNIPGTADDRRLTDLGVGGSAKSSGTLAATARAIRIAIANGDIPASQATELEAFAQASEDAALVFYNYVLANPTAPIGSYSTHGGIANSRLLAEVQLYLLTGDTDYRDAAAAQINSLTLADLSSTNYWDMRPMSMAELYPQADSATQAHIQDLLKQQVDYFLSLADDTPYGVLNRFGNFGVNEPHVSYLGDLMRYYELFGDETVLEAIQRGLYWVFGQNPWNISWVSGIGTDYTRFLHTRFDEEANSAAGQGIVLPGAMVSGPNMKDPTNRQSVSPWYDDRSLHTDSINHWRYNEFSISIQAGLLYTIMALSAADTPASAPGTPPTALPILSPSFGDYVRGQVTVQVPAIAGLSDFAFFTPGSAYTPMTLEGDVYTAVIDESATAAYTNKRVEVRAVDSAGSFTYSSVQYTVAPPLPAPASPLVYDDMGGGGWWGAVGGNNQWVNWYTQNGGTATFAKENVDGRTVGRFTQTPGSATSAAKFQPWHDTADLSGYRYIRFTAKNPGYADLRMRVELSDGTRTHNLTGGWIPVPETWTELQFDLNTLAHPVNKKTSKLSVWLNQSTGSYGELLVDDIRAVNTATGSAPVLTDGTVTPASGGEETDFTFAVTYTDADNEAPYAVELNVGGVLHRMSAVDPADTNYTDGKSYAVTAKLPQGTHTYAFQTTDTTSEAVVTLPASLSVSASGDSEPEPGSDPGVLFTDDFSDEASAWTTTSGTWSIQDGAYVGQASSGTSLALAGDSTWSDYTYEARVSITNNSGGNKDAGLVFRHTDMDNGYILYLKNNDRSGRKLELIRNVGGVRTTLAFANPSIAADTFYTYKIVLEGDSIEVYQDDVLQLSTTDNTHSTGAIGLRVYANTKALFDDVVVTD

SEQ ID NO: 91 - DNA, 4239 bp, Artificial Sequence
  Synthetic construct
  CDS (1)..(4236)
  sig_peptide (1)..(81)
  mat_peptide (82)..(4236)
atgaaaaaaccgctggggaaaattgtcacaagcaccgcactactcatttctgttgcttttagttcatcgatcgcatcggctgccactccccccttgcccgggccgggcacgcccctgatctatgatgatttcggtggcggcggcgtgttcaagcagaattggatgaattggtacaaccaggccggcggcaccggcacgttctcgcgcacgaccgtggacggacgcagcgttggcgtgttcgcccagacgcccgccaccgcttcatcctgggccaagttccagccctggaacgaggaagtcgacctctcgggttaccgttatgtcaacgctacggtgcgcaatcccgactaccccgatgcccgtctgcgcattgcggtacaggacggcacccgcagcgtcaacctcaccgacggctgggtcgccgtggatgaggactggacaacactgacgctcgatctggacgcactctcccccgctttggacaagaagaagattcgcttcgagatctggctgcgtcagactggcggtgcgtatggcgagattctcgtggacgagctcaccgccaccaccgcgcagagcggctccgcgccgatcctctcgaattacggcgtcaccgccaacaccagcggcgcctacacgcagaacacgatctttaccttccgtgccacatacactgatgcggacaacgaacagccttttgccatgcaagtcatcatcaatgacaccccctacgccatgcgggaagtggatcccggcgatctggactataccgacggcaaggcctatacctacacaacacagctgccgccaggcggacatgcctattccttccgcaccaccgatactacctctgacggcgatcagaccgccgtgcagcctggcctcaccgtcagtcttgccgagcaagcaattgatgtggtcgtcagccaggctggctacagtgccagcgacctcaagacagcacaagttgtcgcggtacaaccgctcagcgacttgagctatgaagtgcacagcggcggctcggccgtccataccggcacactgtcttatgagggggttgtctgggacaagcacgtatacaccgctgacttctcgacattcactgccgcgagcggcagctttacagtcgtcagtaacgacatctcctcctacccctttcccatccagaccaacgtctgggacaactacagagatgagatgaccgccttttatcgcctcctgcgcgccggcgttgccacggaggatgcttatccggcaggctacagtacagcagcgccctcagccaagctgtaccatccggccggtcatctcgacgacgcggcttctgccgacggctcacagcagtacgacttgaccggcagctggtacgacgctggcgactatggcaagtacggcggcaatcaatgggtcggcgcccagatcgcgctgtcgtacattcgccatgctgatcaaacggctgtcaaatatgacctagatggcaatggcattcccgatctgatcgacgaggccgtgttcggcagcgaatatctgatcaagttcgccgaccaactgggcggcgcgatgtacaatctgcgcaacaacgccagcttcgtgcatccgcacaaagccaccgacaacatccccggcaccgctgacgaccggcgcctgaccgatctcggcgttggcggctctgccaaatcctcagggacgctcgctgctacggcgcgggcgatccgtatcgccatcgccaacggcgatatccctgccagccaggcgacagaactggaggcgtttgcccaggccagcgaggatgcggcactggtattctataattacgtactcgccaatccgaccgctcccattggcagctacagcacgcatggcggcatcgccaactcacggctgctcgccgaggtgcagctgtatctgctgaccggcgacaccgattaccgggatgccgccgcagcccagattaacagcctgactctggccgatctgtcttcgacgaactactgggacatgcggccgatgtcgatggctgagctgtatccgcaagccgacagtgccacccaggcccacatccaggacttgctcaagcagcaggtcgactacttcctctcgcttgctgacgatacgccatacggcgtgctgaaccgcttcggcaacttcggcgtgaatgagccccatgtctcgtatctcggcgacctgatgcgctactacgagctgttcggtgacgagaccgtgctcgaagccattcaacgcgggctgtattgggtgtttggccaaaatccatggaatatcagctgggtgtcgggtatcggcaccgactacacccgcttccttcatacacgttttgatgaagaagcaaactccgctgccggccaaggtattgtccttcccggcgccatggttagcggacccaacatgaaagatccgacgaaccggcagagcgtcagtccttggtacgacgaccgttcgctgcataccgacagtattaaccactggcgctacaacgagttcagcatcagcatccaggccggactgttgtacacgattatggcgctgagcgcagctgacaccccggcttcggcaccaggtacgccgccgactgcgctgccgatcctctcgccttcctttggcgactatgtgcggggccaagtcaccgttcaggtgcctgccattgccggtctgagtgacttcgccttctttacgccaggctcggcttacaccccaatgacgctggagggcgatgtctataccgcagtgatcgacgaatcagcgaccgccgcctacaccaacaaacgtgtcgaggtccgggccgtagacagcgctggcagcttcacctacagctctgtgcaatacactgtcgcaccgccgctgcctgcccccgcctcgccactcgtctatgacgacatgggcggcggcggctggtggggtgcggttggcggcaataatcaatgggtcaactggtatacgcaaaatggcggcaccgctaccttcgccaaggagaacgtggacggccggacagtcggtcgcttcacacaaacaccgggctccgcgacctcagccgcgaagttccagccttggcatgataccgccgacctctcgggttaccgctatattcgattcacagccaaaaatccggggtacgccgacctccgtatgcgtgtcgaactgtcggacggtacccgcacgcacaacctgacgggcggttggataccggtacccgagacttggacagaactgcaattcgacctgaatacgctggcacatccggtcaataagaagacctccaagctgtccgtctggctgaatcagtcgaccggcagctacggcgagctgctcgtagatgacatccgggcggtcaacacagctaccggaagtgcgcctgtgctgactgacggcacagtgacaccagctagcggcggcgaagaaaccgactttaccttcgcagtcacctacaccgatgccgacaatgaagcgccttacgccgtagaactgaacgtgggcggcgttctgcaccggatgagcgccgtcgatccggccgacaccaactacaccgacggcaagagctatgctgtaacagcgaagctgccgcagggtacgcacacgtatgctttccagacaacggataccacctcggaggccgtcgtcacgctcccggccagcttgtctgtcagcgctagcggggacagcgagcccgaaccgggatctgatcctggagtactgttcaccgatgacttcagtgacgaggccagcgcgtggacgacaaccagcggcacctggagcattcaggacggcgcctatgtcggccaggcaagcagcgggacctcgctagctcttgccggggacagcacctggagtgattacacgtatgaagcccgcgtcagcatcaccaacaattccgggggcaacaaggacgcggggctggtattccgtcacaccgatatggacaacgggtacatcctctacctcaagaacaacgaccgcagcggccgcaagctggagctgatccgcaacgttggcggtgtccggacgacactggcctttgctaacccgagcatcgctgcggacaccttctatacgtacaaaatcgtactcgaaggcgactccatcgaggtgtaccaggacgatgtgctccaactgagcactacggacaacacccatagcaccggcgccattggcctgcgggtctacgccaataccaaagcgctctttgacgacgtagtggtaaccgaccatcatcaccatcaccactaa

SEQ ID NO: 92 - protein, 1412 aa, Artificial Sequence
  Synthetic Construct
MKKPLGKIVTSTALLISVAFSSSIASAATPPLPGPGTPLIYDDFGGGGVFKQNWMNWYNQAGGTGTFSRTTVDGRSVGVFAQTPATASSWAKFQPWNEEVDLSGYRYVNATVRNPDYPDARLRIAVQDGTRSVNLTDGWVAVDEDWTTLTLDLDALSPALDKKKIRFEIWLRQTGGAYGEILVDELTATTAQSGSAPILSNYGVTANTSGAYTQNTIFTFRATYTDADNEQPFAMQVIINDTPYAMREVDPGDLDYTDGKAYTYTTQLPPGGHAYSFRTTDTTSDGDQTAVQPGLTVSLAEQAIDVVVSQAGYSASDLKTAQVVAVQPLSDLSYEVHSGGSAVHTGTLSYEGVVWDKHVYTADFSTFTAASGSFTVVSNDISSYPFPIQTNVWDNYRDEMTAFYRLLRAGVATEDAYPAGYSTAAPSAKLYHPAGHLDDAASADGSQQYDLTGSWYDAGDYGKYGGNQWVGAQIALSYIRHADQTAVKYDLDGNGIPDLIDEAVFGSEYLIKFADQLGGAMYNLRNNASFVHPHKATDNIPGTADDRRLTDLGVGGSAKSSGTLAATARAIRIAIANGDIPASQATELEAFAQASEDAALVFYNYVLANPTAPIGSYSTHGGIANSRLLAEVQLYLLTGDTDYRDAAAAQINSLTLADLSSTNYWDMRPMSMAELYPQADSATQAHIQDLLKQQVDYFLSLADDTPYGVLNRFGNFGVNEPHVSYLGDLMRYYELFGDETVLEAIQRGLYWVFGQNPWNISWVSGIGTDYTRFLHTRFDEEANSAAGQGIVLPGAMVSGPNMKDPTNRQSVSPWYDDRSLHTDSINHWRYNEFSISIQAGLLYTIMALSAADTPASAPGTPPTALPILSPSFGDYVRGQVTVQVPAIAGLSDFAFFTPGSAYTPMTLEGDVYTAVIDESATAAYTNKRVEVRAVDSAGSFTYSSVQYTVAPPLPAPASPLVYDDMGGGGWWGAVGGNNQWVNWYTQNGGTATFAKENVDGRTVGRFTQTPGSATSAAKFQPWHDTADLSGYRYIRFTAKNPGYADLRMRVELSDGTRTHNLTGGWIPVPETWTELQFDLNTLAHPVNKKTSKLSVWLNQSTGSYGELLVDDIRAVNTATGSAPVLTDGTVTPASGGEETDFTFAVTYTDADNEAPYAVELNVGGVLHRMSAVDPADTNYTDGKSYAVTAKLPQGTHTYAFQTTDTTSEAVVTLPASLSVSASGDSEPEPGSDPGVLFTDDFSDEASAWTTTSGTWSIQDGAYVGQASSGTSLALAGDSTWSDYTYEARVSITNNSGGNKDAGLVFRHTDMDNGYILYLKNNDRSGRKLELIRNVGGVRTTLAFANPSIAADTFYTYKIVLEGDSIEVYQDDVLQLSTTDNTHSTGAIGLRVYANTKALFDDVVVTDHHHHHH

SEQ ID NO: 93 - DNA, 4227 bp, Paenibacillus sp
  CDS (1)..(4224)
  sig_peptide (1)..(111)
  mat_peptide (112)..(4224)
atgattgccaaaaaaggtttgaaaacccgcatgcagcaagtcttattgacagggctggggctcgtgctggccttgaatgtcttttttttgccgcctcgtactgttcaggccgctccggctccgctgccgggaccgagcaaccctttgatttacgacgacttcgcgggcggaggcgtgttcaagcaaaattggatgaactggtggaatcaggacgggggtgtaggcaccttctccaaaacgacggaggacggccgctcgatcggcgtatttgcgcaaactccggcatcgagctcgtcgtgggccaaatttcagccatggaatgaaaccgtcaacttgacggggtatcgctacattaatgtcagcctgaaaaatcccggttatgagaacgccctgatgcgcattctgatcaacgacggctcgcgcaatatactgattacggaaggatgggcgccggttccggacgactggacaacgctgcagttggacctggacgcgctggagcctgcagtcaacaaacggaatatcaaatttgaaatctggctgcgccagacgggcgggagctacggcgaaatctgggtggacgacattaccgccacaacggcttcatccggcaccgcgccgacgctgaccgcaaccggcgtaaccgccaacaccgacggcgcctacaatcaaaatacggtattcaccttcgctgcaacctacacggacgccgataatgaagctccgttcgccatgcaggtcatcattgatgatctggtctacgacatgcgggagatcgattacggagatacgacttatacggacggcaaagcgtatacctattcaaccaagctgtctcccggctcccactcctactacttccgcgcaaccgatctgacctcggacggcgccgagacgacgctgcagtcgggccttaacgtcatttactcggagcagatcattgatgtcgtcgtcagccaggcgggctacagcgccggcgactacaaaaatgccaaggttgtatcgtcgcttcctctgaccaatacctcttatgaggtgctggacggatcgagcacgctcgtcgcgtctggcgacctcatctacgagggcattacctggaacaaacatgtctatgcgatcgacttcagctccgtcacctcgaccggaaacgcttttacgatcaagagcaacggcatttcctcttatccattccctattcagtcgaatatatgggacagctataaggatgaaatgacggcattctaccgtatccaacgcgccggcgtggccacctcggaggcctatcctcccggctacagcagcatagcgccttccgccaaagtctatcatccggcggggcatctggacgatgcggtctccgctgacggcacccagcaatacgatttggtcggcggctggtacgatgcgggcgattacggccaatacggcggcaatcagtgggtcggcgcccagatcgccctcgcctatattcgatacgccgagcataacagcgtgaaatacgacaatgacggcaacggcattcccgatctggtcgacgaagcgatattcggcagcgaatatttgatcaaattcgcgaatcagcttggcgggcagatgttcaatctgcggaataacgcctcgttcattcatccgcataaggcgactgataatattccgggcacggccgatgaccgcaagctggtcgatccgggcgttggcggctccgccaaatcggccggtacgctggccgcaaccgcgcgggcgatctatgccgccatcgccgaaggcgatatcgatccggcgaagatcgtcgagcttgaggcgtttgccgccgaatgcgaagcggccgctgttattttctacgactatgcggcggcccatccgaatgatcccgtcggcagctacacgaccagaggcggccttccgaactccatgctgcttgcggaggttcagctgtacctgctgacggacgacagcgattacagagatgccgccgtaacgcagatcaacggtcttgcgtttgaggatctgtttgcaaccaactattgggatatgcgtccgatgtcgatggcggaactttatccgcatgtcgacccggccacgcaagcgcatattcagctgttgctcaagcagcaggtggatttcttcctctcctcgacggacgatacgccgtacggcgtgcttaaccagttcaaaaacttcggcgtcaacgagccgcatgtttcctatttgggagatttgctgcgctactatgagctgtttggcgatccggccgccctgcgcgcggtgctgaagggcatgtactgggttttcggcgaaaatccgtggaatatcagctgggtatccggcattggcgcgaatcatgtcaagtttttgcatacccgtctggatgagcaggcaaactcgccgaccgccacaggcattgtcattcccggcgcgatggtgagcggaccgaatatgaaggatacgaaaaacaaaaaaagcgtcagtccgtggtacgaggatcgctcgctctatcaggatgacgtcaatcaatggcggtacaatgaatacagcgtcagtatccaggtcggcctgctgtacacgattatgggcctcagcacgctggataacgccagctccgaaggcggcgtctatccggtcgaactgccgattctgtcgccgactatcggggattacgtccgcggtcaggtgactgtgctcgccgctccggcgccggggcttgtcgccatggacttttcgtccggcggagcgtacagcgcgatgaccccttcgggcacagcctacgccgcgacgatcgacgaaagcgcatctaacccttacgcgaatcggagaattgatgtgagaggcatcgacgccgcgggcaaccgcacctacagctcgacccattatacggtggcgcagccgctgcccgatccttccactccgcttctctatgacgacttcggaggcaacggattatggggcgcggcaggcggcaacaactcatgggtcaactggtatacgcaaaacggcggcagcgccacctttgccagaacgaccgaggacggccgcacggtcggcaagtttacgcagacgccgtcctccggcacatccaatgccaaattccagccttggcatgatgtcgtcgatttgtccggctatcgctatgttaactttacagtgaaaaatggcggctatcccgacctgaggatgcggatcgaaatgtcggacggcaatcgtacgtacaatttaaccggcggctgggcaagcgttccgaacgactggaccgagcttcaattcgatctcgacgcgctcgtgcctgccgcgaacaaagctgcggcgcgcttctccgtctggctgaatcagtccgggggcagctacggcgaaatgttcatcgacgaaatcaaggcggttaatgtcgcgagcggcaacgcgcctacgctgacgggcgccggcgtcgatctgtcggcgggagatacggaaacggaatttacgttcaacgtcacctacacggatgcggacaatgaagcgccgtttgcgctggagtttgtgctgaacggcgtcatccatcacatggagccggtcgatccgggagatacgacttactcggacggcaaggattacgcatacacaacacgtttgccgattggcatccattcgtattacttccacacgaccgacacttcgtccgatgcggtcagcaccgccgttctggcaggtccgaccgtcacggccgctgcccaaacactgttcttcgacgacttcgaggatggcaatgcggacggctggacgccgacaagcggaacatggtcggtgcaaagcggcgtctacggcggacaagcgagttccatgaacagctattcgattgcgggagacgcaaactggacggactacacgctggaggcaaaggtaagcgtcacgaacaattccgctggcaacaaggacgcgggactcgtgttccgctatacggataccgacaaccactacatcctctaccttaaaaacaacgaccgcagcggtcgcaagatggagcttgtccgggtcgtcggcgggtccaaaacgacactggacttcgccaatccgagcattgcagcggataccttctacacatacaagatcgtattgaacggcgattcgattgaagtatacaaggacggcgatctggtgctgagcaccacggacaacgcgcactcgagcggtaaaatcggcgcccgcgtctacgcgaatacgaaggcgtggttcgacgatgtgacggtgcggggctag

SEQ ID NO: 94 - protein, 1408 aa, Paenibacillus sp
MIAKKGLKTRMQQVLLTGLGLVLALNVFFLPPRTVQAAPAPLPGPSNPLIYDDFAGGGVFKQNWMNWWNQDGGVGTFSKTTEDGRSIGVFAQTPASSSSWAKFQPWNETVNLTGYRYINVSLKNPGYENALMRILINDGSRNILITEGWAPVPDDWTTLQLDLDALEPAVNKRNIKFEIWLRQTGGSYGEIWVDDITATTASSGTAPTLTATGVTANTDGAYNQNTVFTFAATYTDADNEAPFAMQVIIDDLVYDMREIDYGDTTYTDGKAYTYSTKLSPGSHSYYFRATDLTSDGAETTLQSGLNVIYSEQIIDVVVSQAGYSAGDYKNAKVVSSLPLTNTSYEVLDGSSTLVASGDLIYEGITWNKHVYAIDFSSVTSTGNAFTIKSNGISSYPFPIQSNIWDSYKDEMTAFYRIQRAGVATSEAYPPGYSSIAPSAKVYHPAGHLDDAVSADGTQQYDLVGGWYDAGDYGQYGGNQWVGAQIALAYIRYAEHNSVKYDNDGNGIPDLVDEAIFGSEYLIKFANQLGGQMFNLRNNASFIHPHKATDNIPGTADDRKLVDPGVGGSAKSAGTLAATARAIYAAIAEGDIDPAKIVELEAFAAECEAAAVIFYDYAAAHPNDPVGSYTTRGGLPNSMLLAEVQLYLLTDDSDYRDAAVTQINGLAFEDLFATNYWDMRPMSMAELYPHVDPATQAHIQLLLKQQVDFFLSSTDDTPYGVLNQFKNFGVNEPHVSYLGDLLRYYELFGDPAALRAVLKGMYWVFGENPWNISWVSGIGANHVKFLHTRLDEQANSPTATGIVIPGAMVSGPNMKDTKNKKSVSPWYEDRSLYQDDVNQWRYNEYSVSIQVGLLYTIMGLSTLDNASSEGGVYPVELPILSPTIGDYVRGQVTVLAAPAPGLVAMDFSSGGAYSAMTPSGTAYAATIDESASNPYANRRIDVRGIDAAGNRTYSSTHYTVAQPLPDPSTPLLYDDFGGNGLWGAAGGNNSWVNWYTQNGGSATFARTTEDGRTVGKFTQTPSSGTSNAKFQPWHDVVDLSGYRYVNFTVKNGGYPDLRMRIEMSDGNRTYNLTGGWASVPNDWTELQFDLDALVPAANKAAARFSVWLNQSGGSYGEMFIDEIKAVNVASGNAPTLTGAGVDLSAGDTETEFTFNVTYTDADNEAPFALEFVLNGVIHHMEPVDPGDTTYSDGKDYAYTTRLPIGIHSYYFHTTDTSSDAVSTAVLAGPTVTAAAQTLFFDDFEDGNADGWTPTSGTWSVQSGVYGGQASSMNSYSIAGDANWTDYTLEAKVSVTNNSAGNKDAGLVFRYTDTDNHYILYLKNNDRSGRKMELVRVVGGSKTTLDFANPSIAADTFYTYKIVLNGDSIEVYKDGDLVLSTTDNAHSSGKIGARVYANTKAWFDDVTVRG

SEQ ID NO: 95 - DNA, 4221 bp, Artificial Sequence
  Synthetic construct
  CDS (1)..(4218)
  sig_peptide (1)..(81)
  mat_peptide (82)..(4218)
atgaagaaaccgttggggaaaattgtcgcaagcaccgcactactcatttctgttgcttttagttcatcgatagcatcagcacatcatcatcaccatcatcctagggctccggctccgctgccgggaccgagcaaccctttgatttacgacgacttcgcgggcggaggcgtgttcaagcaaaattggatgaactggtggaatcaggacgggggtgtaggcaccttctccaaaacgacggaggacggccgctcgatcggcgtatttgcgcaaactccggcatcgagctcgtcgtgggccaaatttcagccatggaatgaaaccgtcaacttgacggggtatcgctacattaatgtcagcctgaaaaatcccggttatgagaacgccctgatgcgcattctgatcaacgacggctcgcgcaatatactgattacggaaggatgggcgccggttccggacgactggacaacgctgcagttggacctggacgcgctggagcctgcagtcaacaaacggaatatcaaatttgaaatctggctgcgccagacgggcgggagctacggcgaaatctgggtggacgacattaccgccacaacggcttcatccggcaccgcgccgacgctgaccgcaaccggcgtaaccgccaacaccgacggcgcctacaatcaaaatacggtattcaccttcgctgcaacctacacggacgccgataatgaagctccgttcgccatgcaggtcatcattgatgatctggtctacgacatgcgggagatcgattacggagatacgacttatacggacggcaaagcgtatacctattcaaccaagctgtctcccggctcccactcctactacttccgcgcaaccgatctgacctcggacggcgccgagacgacgctgcagtcgggccttaacgtcatttactcggagcagatcattgatgtcgtcgtcagccaggcgggctacagcgccggcgactacaaaaatgccaaggttgtatcgtcgcttcctctgaccaatacctcttatgaggtgctggacggatcgagcacgctcgtcgcgtctggcgacctcatctacgagggcattacctggaacaaacatgtctatgcgatcgacttcagctccgtcacctcgaccggaaacgcttttacgatcaagagcaacggcatttcctcttatccattccctattcagtcgaatatatgggacagctataaggatgaaatgacggcattctaccgtatccaacgcgccggcgtggccacctcggaggcctatcctcccggctacagcagcatagcgccttccgccaaagtctatcatccggcggggcatctggacgatgcggtctccgctgacggcacccagcaatacgatttggtcggcggctggtacgatgcgggcgattacggccaatacggcggcaatcagtgggtcggcgcccagatcgccctcgcctatattcgatacgccgagcataacagcgtgaaatacgacaatgacggcaacggcattcccgatctggtcgacgaagcgatattcggcagcgaatatttgatcaaattcgcgaatcagcttggcgggcagatgttcaatctgcggaataacgcctcgttcattcatccgcataaggcgactgataatattccgggcacggccgatgaccgcaagctggtcgatccgggcgttggcggctccgccaaatcggccggtacgctggccgcaaccgcgcgggcgatctatgccgccatcgccgaaggcgatatcgatccggcgaagatcgtcgagcttgaggcgtttgccgccgaatgcgaagcggccgctgttattttctacgactatgcggcggcccatccgaatgatcccgtcggcagctacacgaccagaggcggccttccgaactccatgctgcttgcggaggttcagctgtacctgctgacggacgacagcgattacagagatgccgccgtaacgcagatcaacggtcttgcgtttgaggatctgtttgcaaccaactattgggatatgcgtccgatgtcgatggcggaactttatccgcatgtcgacccggccacgcaagcgcatattcagctgttgctcaagcagcaggtggatttcttcctctcctcgacggacgatacgccgtacggcgtgcttaaccagttcaaaaacttcggcgtcaacgagccgcatgtttcctatttgggagatttgctgcgctactatgagctgtttggcgatccggccgccctgcgcgcggtgctgaagggcatgtactgggttttcggcgaaaatccgtggaatatcagctgggtatccggcattggcgcgaatcatgtcaagtttttgcatacccgtctggatgagcaggcaaactcgccgaccgccacaggcattgtcattcccggcgcgatggtgagcggaccgaatatgaaggatacgaaaaacaaaaaaagcgtcagtccgtggtacgaggatcgctcgctctatcaggatgacgtcaatcaatggcggtacaatgaatacagcgtcagtatccaggtcggcctgctgtacacgattatgggcctcagcacgctggataacgccagctccgaaggcggcgtctatccggtcgaactgccgattctgtcgccgactatcggggattacgtccgcggtcaggtgactgtgctcgccgctccggcgccggggcttgtcgccatggacttttcgtccggcggagcgtacagcgcgatgaccccttcgggcacagcctacgccgcgacgatcgacgaaagcgcatctaacccttacgcgaatcggagaattgatgtgagaggcatcgacgccgcgggcaaccgcacctacagctcgacccattatacggtggcgcagccgctgcccgatccttccactccgcttctctatgacgacttcggaggcaacggattatggggcgcggcaggcggcaacaactcatgggtcaactggtatacgcaaaacggcggcagcgccacctttgccagaacgaccgaggacggccgcacggtcggcaagtttacgcagacgccgtcctccggcacatccaatgccaaattccagccttggcatgatgtcgtcgatttgtccggctatcgctatgttaactttacagtgaaaaatggcggctatcccgacctgaggatgcggatcgaaatgtcggacggcaatcgtacgtacaatttaaccggcggctgggcaagcgttccgaacgactggaccgagcttcaattcgatctcgacgcgctcgtgcctgccgcgaacaaagctgcggcgcgcttctccgtctggctgaatcagtccgggggcagctacggcgaaatgttcatcgacgaaatcaaggcggttaatgtcgcgagcggcaacgcgcctacgctgacgggcgccggcgtcgatctgtcggcgggagatacggaaacggaatttacgttcaacgtcacctacacggatgcggacaatgaagcgccgtttgcgctggagtttgtgctgaacggcgtcatccatcacatggagccggtcgatccgggagatacgacttactcggacggcaaggattacgcatacacaacacgtttgccgattggcatccattcgtattacttccacacgaccgacacttcgtccgatgcggtcagcaccgccgttctggcaggtccgaccgtcacggccgctgcccaaacactgttcttcgacgacttcgaggatggcaatgcggacggctggacgccgacaagcggaacatggtcggtgcaaagcggcgtctacggcggacaagcgagttccatgaacagctattcgattgcgggagacgcaaactggacggactacacgctggaggcaaaggtaagcgtcacgaacaattccgctggcaacaaggacgcgggactcgtgttccgctatacggataccgacaaccactacatcctctaccttaaaaacaacgaccgcagcggtcgcaagatggagcttgtccgggtcgtcggcgggtccaaaacgacactggacttcgccaatccgagcattgcagcggataccttctacacatacaagatcgtattgaacggcgattcgattgaagtatacaaggacggcgatctggtgctgagcaccacggacaacgcgcactcgagcggtaaaatcggcgcccgcgtctacgcgaatacgaaggcgtggttcgacgatgtgacggtgcggggctaa

SEQ ID NO: 96 - protein, 1406 aa, Artificial Sequence
  Synthetic Construct
MKKPLGKIVASTALLISVAFSSSIASAHHHHHHPRAPAPLPGPSNPLIYDDFAGGGVFKQNWMNWWNQDGGVGTFSKTTEDGRSIGVFAQTPASSSSWAKFQPWNETVNLTGYRYINVSLKNPGYENALMRILINDGSRNILITEGWAPVPDDWTTLQLDLDALEPAVNKRNIKFEIWLRQTGGSYGEIWVDDITATTASSGTAPTLTATGVTANTDGAYNQNTVFTFAATYTDADNEAPFAMQVIIDDLVYDMREIDYGDTTYTDGKAYTYSTKLSPGSHSYYFRATDLTSDGAETTLQSGLNVIYSEQIIDVVVSQAGYSAGDYKNAKVVSSLPLTNTSYEVLDGSSTLVASGDLIYEGITWNKHVYAIDFSSVTSTGNAFTIKSNGISSYPFPIQSNIWDSYKDEMTAFYRIQRAGVATSEAYPPGYSSIAPSAKVYHPAGHLDDAVSADGTQQYDLVGGWYDAGDYGQYGGNQWVGAQIALAYIRYAEHNSVKYDNDGNGIPDLVDEAIFGSEYLIKFANQLGGQMFNLRNNASFIHPHKATDNIPGTADDRKLVDPGVGGSAKSAGTLAATARAIYAAIAEGDIDPAKIVELEAFAAECEAAAVIFYDYAAAHPNDPVGSYTTRGGLPNSMLLAEVQLYLLTDDSDYRDAAVTQINGLAFEDLFATNYWDMRPMSMAELYPHVDPATQAHIQLLLKQQVDFFLSSTDDTPYGVLNQFKNFGVNEPHVSYLGDLLRYYELFGDPAALRAVLKGMYWVFGENPWNISWVSGIGANHVKFLHTRLDEQANSPTATGIVIPGAMVSGPNMKDTKNKKSVSPWYEDRSLYQDDVNQWRYNEYSVSIQVGLLYTIMGLSTLDNASSEGGVYPVELPILSPTIGDYVRGQVTVLAAPAPGLVAMDFSSGGAYSAMTPSGTAYAATIDESASNPYANRRIDVRGIDAAGNRTYSSTHYTVAQPLPDPSTPLLYDDFGGNGLWGAAGGNNSWVNWYTQNGGSATFARTTEDGRTVGKFTQTPSSGTSNAKFQPWHDVVDLSGYRYVNFTVKNGGYPDLRMRIEMSDGNRTYNLTGGWASVPNDWTELQFDLDALVPAANKAAARFSVWLNQSGGSYGEMFIDEIKAVNVASGNAPTLTGAGVDLSAGDTETEFTFNVTYTDADNEAPFALEFVLNGVIHHMEPVDPGDTTYSDGKDYAYTTRLPIGIHSYYFHTTDTSSDAVSTAVLAGPTVTAAAQTLFFDDFEDGNADGWTPTSGTWSVQSGVYGGQASSMNSYSIAGDANWTDYTLEAKVSVTNNSAGNKDAGLVFRYTDTDNHYILYLKNNDRSGRKMELVRVVGGSKTTLDFANPSIAADTFYTYKIVLNGDSIEVYKDGDLVLSTTDNAHSSGKIGARVYANTKAWFDDVTVRG

SEQ ID NO: 97 - DNA, 4230 bp, Paenibacillus sp
  CDS (1)..(4227)
  sig_peptide (1)..(111)
  mat_peptide (112)..(4227)
atgtggtcaaagcttcgtttgagagaaaaagcgcggcagcggctgtcgctcggccttgccatcgcgctcgtgctgcagtcgcttgttctgctgcccggcgccgcttcctccgccgtgccgccgttgccgaacccgagcaacccgctcgtctatgacgattttgccgggggcggcgtatttaaacagaactggatgaactggtacaaccaggacggcggggtcggcgctttcagcaagacgacggtcgacggccgttccgtcggcgtgttcgcgcagactccggcttccggctcttcgtgggcgaaatttcagccgtggaacgaaaccgtcgatttgaccggctaccgctatttgaattttatgcttaaaaatccgggatacccggacgcacgcgttcgtctggtcgtcaacgacggagcgagaagctataatttgacgaacggctgggccgaggtgccggacgactggacgctgtatcaatacgatatggacgcgctgacgcctccgatcaataaaaagacagcccgcttcgaaatatggctgcggcaaacgagcggcgcctacggcgaaattttgttcgacgacatctccgccgtcaccgcatccacaggcacccagccgacgctgacgaacaccgggctgagctttaattcggacaatattcacacgcaaaatacgcgttataccttctatgcgacgtatacggacgcggataacgagaagccatttgcgatgcaggtgatcataggcgataccgcatacgatatgaaagaaacggattataccgacacgaactacaccgacggcaagggctatacgtacacgaccaagctgcccgtgggcagccatccgtactatttccgcgccaccgacaccacctccgacgtcgtggtcactccggtgcaggcggggcctacggtcgtctattcggagcaggcgatcgacgtcgtcgtgagccaggccggatacggcgcgaacgactacaaaagcgccaaagtgacggcgaagctgccgctaggcgacaccgccttcgaagtatggaacggctcttccgttgcggcggcgggcaatctggtctacgaaggcttcgtctgggacaagcacgtctatacggccgaattctcctccgtcaccgcgccgggcaacagctatacggtgcgaagcaacgggttctcgtcctacgcttttccgattcagccgaatatatgggacagctacaaagacgaaatgacggcgttctaccgcattcagcgcgccagcgtcgcgaccgcggacgtctatccgccgggctacagcaccgtgccgccttcgccgaaggtattccatccggccggacatctcgatgacgccgcatctcccgacggcacggtgcattacgatctgaccggcagttggtacgacgccggcgattacgggaagtatggcggcaatcagtgggttggcgcgcaaatcgccctcgcctacatccgccatgccgaagcacccagcgtgaagttcgacaacgacaataacggcattcccgatcttgtcgacgaagcggtcttcggcagcgaatatttgatcaagtttgcgaatcagctcggcggcgcgatgtacaacatcaagaacaacgcttcgttcgtccatccgcataaatcgacggacaacattccgggcacggccgacgacaggaagctcgtcgattacggcatcggcggttccgccaaggccgcgggtacgctggccgcgacggcgcgcgccattcacaaggcgattgccgaaggcgacatcgaaccggccaagaccgcgcagctttccgccttcgccgccgagtgcgaggcggcggccgtcacgttctacaactacgtgctcgcgcatccgaacgacccgatcgggtcgtattcgacccgcggcggcatcgccaattcgatgcttttggcgcaggtgcagctctatctgctgaccaatgacaccgcttacagagacgcggcggcggccgagatcaacagcctgaccttcgacgacctgtatgcgacaaactactgggatatgcggccgatgtcgatggcggaattttatccggttgccgatccggcgacgcaggctcatattcatagcttgctgaagcagcaggtcgactacttcctgtcctcgacggacgatacgccttacggcgtgttgaaccagttcaaaaacttcggcgtcaacgagccgcatgtttcttatctgggcgatttgatgcgctattacgagctgttcgaggacccggcggcgctgcgcggcattttgaagggcatgtactgggtattcggggaaaatccgtggaatatcagctgggtttcgggcatcggcgaggatcatgtcgacttcctgcatacccgcttcgacgaggaagcgaacacggcgacgggcaaagggatcgtcatccccggcgcgatggtcagcggcccgaatatgaaggatcctaaagacaagcgcagcgtcagcccttggtatgaggaccgttcgctccacagcgacgataccagccagtggcggtacaacgagtacagcatcagcattcaggccgggctgctctatacgattatggggctgagcgccgtcgatacgtcaggcgcttccgaggtcgcgtacccggcagagctgccgattctctcccccgtcatcggcgattatgtgaggggccaggtgaccgtgttcgcggaggcgcctgccgaaattgtcgctgcggattatacggcgggatcgggctacagcgccatgacgaaaaccggcggcatctataccggaacggtcgacgaaagcgcgacggctccgttcatcaaccggagagtcgacgtgcggggaagcgacggcaacggcaatttcacctacagctcgacgcattatacggttgcgccgccgctgcccggtccgtccacgccgctgctgtacgacgatttcggcggaggcggactgtggggttcgacgggcggcaacaatcagtgggtgaactggtacacccagaacggcggcacggccaccttcgcgaagacgacggaagacggccgcacggtcggcaaattcacgcagacgccggcctccgccagctcgaacgccaagttccagccatggcatgacgccgtcgacctgtcgggctaccgttatgtgaacgtcaccgtgaaaaatccggctcatccggatctgcggatgcgaatcgagctgtcggacggcagccgcacgtacaacctgaccggcggttggataaccgtaccggcggagtggaccgatctgcagttcgatctggacgcgctcgtgccgaaggtgaacaagcaggcggcgaagttctcgctatggcttaaccaaagcaccggcagctacggcgaaatgttcgtcgacgagtggaaagcgaccaacgccgccagcggcagcgcgccgacgctcaccgatgccggcgtggaccaggcttccggcgacccggacaccgatttcacgttcagcgtcacttatacggatgccgacaacgagccgcctttcgccatggagctcgtcctgaacggggtcgttcacacgatgcagcctgtcgacgcgagcgataccaactatgccgacggcaagcagtatcaatacatgacgaagctgcatccgggcgcgcacacctactacttccatacgaccgacacgtcctcggatgcggtgagcacaccggtcctgaccgggccgaccgtgagccgggcgctctctaacgagctcttccacgacgattttgaggacggcgacgcggccggctggatcccgacgagcggaacctgggccgtcgagaacggtcaataccgcgggcaggccggctccggccagagcctctcgctcgccggcgacgcagcctggaccgattacgaactgcgggctagagtgaacatcaccaacaatacgaacggcaataaagacgccggattggtgttccgttacacggacgacaacaactactatatcctgtacctgaagaataacgaccggccggggcgcaagatggagctggtcaaagtcgagaacggcgtgaagacgacgctcgcctttgcgaacccgagcattgcggcggatacgtactatacgtatcggattgtcgccagcagtagcgccatcgaagcctacaaggatggcgtcctcgaagtgagcgccaccgacagcgcccacagcgccggcaaaatcggcctgcgcgtctacgccaacaccagggcctacttcgacgacgtgaccgtcacgccaagttag

SEQ ID NO: 98 - protein, 1409 aa, Paenibacillus sp
MWSKLRLREKARQRLSLGLAIALVLQSLVLLPGAASSAVPPLPNPSNPLVYDDFAGGGVFKQNWMNWYNQDGGVGAFSKTTVDGRSVGVFAQTPASGSSWAKFQPWNETVDLTGYRYLNFMLKNPGYPDARVRLVVNDGARSYNLTNGWAEVPDDWTLYQYDMDALTPPINKKTARFEIWLRQTSGAYGEILFDDISAVTASTGTQPTLTNTGLSFNSDNIHTQNTRYTFYATYTDADNEKPFAMQVIIGDTAYDMKETDYTDTNYTDGKGYTYTTKLPVGSHPYYFRATDTTSDVVVTPVQAGPTVVYSEQAIDVVVSQAGYGANDYKSAKVTAKLPLGDTAFEVWNGSSVAAAGNLVYEGFVWDKHVYTAEFSSVTAPGNSYTVRSNGFSSYAFPIQPNIWDSYKDEMTAFYRIQRASVATADVYPPGYSTVPPSPKVFHPAGHLDDAASPDGTVHYDLTGSWYDAGDYGKYGGNQWVGAQIALAYIRHAEAPSVKFDNDNNGIPDLVDEAVFGSEYLIKFANQLGGAMYNIKNNASFVHPHKSTDNIPGTADDRKLVDYGIGGSAKAAGTLAATARAIHKAIAEGDIEPAKTAQLSAFAAECEAAAVTFYNYVLAHPNDPIGSYSTRGGIANSMLLAQVQLYLLTNDTAYRDAAAAEINSLTFDDLYATNYWDMRPMSMAEFYPVADPATQAHIHSLLKQQVDYFLSSTDDTPYGVLNQFKNFGVNEPHVSYLGDLMRYYELFEDPAALRGILKGMYWVFGENPWNISWVSGIGEDHVDFLHTRFDEEANTATGKGIVIPGAMVSGPNMKDPKDKRSVSPWYEDRSLHSDDTSQWRYNEYSISIQAGLLYTIMGLSAVDTSGASEVAYPAELPILSPVIGDYVRGQVTVFAEAPAEIVAADYTAGSGYSAMTKTGGIYTGTVDESATAPFINRRVDVRGSDGNGNFTYSSTHYTVAPPLPGPSTPLLYDDFGGGGLWGSTGGNNQWVNWYTQNGGTATFAKTTEDGRTVGKFTQTPASASSNAKFQPWHDAVDLSGYRYVNVTVKNPAHPDLRMRIELSDGSRTYNLTGGWITVPAEWTDLQFDLDALVPKVNKQAAKFSLWLNQSTGSYGEMFVDEWKATNAASGSAPTLTDAGVDQASGDPDTDFTFSVTYTDADNEPPFAMELVLNGVVHTMQPVDASDTNYADGKQYQYMTKLHPGAHTYYFHTTDTSSDAVSTPVLTGPTVSRALSNELFHDDFEDGDAAGWIPTSGTWAVENGQYRGQAGSGQSLSLAGDAAWTDYELRARVNITNNTNGNKDAGLVFRYTDDNNYYILYLKNNDRPGRKMELVKVENGVKTTLAFANPSIAADTYYTYRIVASSSAIEAYKDGVLEVSATDSAHSAGKIGLRVYANTRAYFDDVTVTPS

SEQ ID NO: 99 - DNA, 4224 bp, Artificial Sequence
  Synthetic construct
  CDS (1)..(4221)
  sig_peptide (1)..(81)
  mat_peptide (82)..(4221)
atgaagaaaccgttggggaaaattgtcgcaagcaccgcactactcatttctgttgcttttagttcatcgatagcatcagcacatcatcatcaccatcatcctagggccgtgccgccgttgccgaacccgagcaacccgctcgtctatgacgattttgccgggggcggcgtatttaaacagaactggatgaactggtacaaccaggacggcggggtcggcgctttcagcaagacgacggtcgacggccgttccgtcggcgtgttcgcgcagactccggcttccggctcttcgtgggcgaaatttcagccgtggaacgaaaccgtcgatttgaccggctaccgctatttgaattttatgcttaaaaatccgggatacccggacgcacgcgttcgtctggtcgtcaacgacggagcgagaagctataatttgacgaacggctgggccgaggtgccggacgactggacgctgtatcaatacgatatggacgcgctgacgcctccgatcaataaaaagacagcccgcttcgaaatatggctgcggcaaacgagcggcgcctacggcgaaattttgttcgacgacatctccgccgtcaccgcatccacaggcacccagccgacgctgacgaacaccgggctgagctttaattcggacaatattcacacgcaaaatacgcgttataccttctatgcgacgtatacggacgcggataacgagaagccatttgcgatgcaggtgatcataggcgataccgcatacgatatgaaagaaacggattataccgacacgaactacaccgacggcaagggctatacgtacacgaccaagctgcccgtgggcagccatccgtactatttccgcgccaccgacaccacctccgacgtcgtggtcactccggtgcaggcggggcctacggtcgtctattcggagcaggcgatcgacgtcgtcgtgagccaggccggatacggcgcgaacgactacaaaagcgccaaagtgacggcgaagctgccgctaggcgacaccgccttcgaagtatggaacggctcttccgttgcggcggcgggcaatctggtctacgaaggcttcgtctgggacaagcacgtctatacggccgaattctcctccgtcaccgcgccgggcaacagctatacggtgcgaagcaacgggttctcgtcctacgcttttccgattcagccgaatatatgggacagctacaaagacgaaatgacggcgttctaccgcattcagcgcgccagcgtcgcgaccgcggacgtctatccgccgggctacagcaccgtgccgccttcgccgaaggtattccatccggccggacatctcgatgacgccgcatctcccgacggcacggtgcattacgatctgaccggcagttggtacgacgccggcgattacgggaagtatggcggcaatcagtgggttggcgcgcaaatcgccctcgcctacatccgccatgccgaagcacccagcgtgaagttcgacaacgacaataacggcattcccgatcttgtcgacgaagcggtcttcggcagcgaatatttgatcaagtttgcgaatcagctcggcggcgcgatgtacaacatcaagaacaacgcttcgttcgtccatccgcataaatcgacggacaacattccgggcacggccgacgacaggaagctcgtcgattacggcatcggcggttccgccaaggccgcgggtacgctggccgcgacggcgcgcgccattcacaaggcgattgccgaaggcgacatcgaaccggccaagaccgcgcagctttccgccttcgccgccgagtgcgaggcggcggccgtcacgttctacaactacgtgctcgcgcatccgaacgacccgatcgggtcgtattcgacccgcggcggcatcgccaattcgatgcttttggcgcaggtgcagctctatctgctgaccaatgacaccgcttacagagacgcggcggcggccgagatcaacagcctgaccttcgacgacctgtatgcgacaaactactgggatatgcggccgatgtcgatggcggaattttatccggttgccgatccggcgacgcaggctcatattcatagcttgctgaagcagcaggtcgactacttcctgtcctcgacggacgatacgccttacggcgtgttgaaccagttcaaaaacttcggcgtcaacgagccgcatgtttcttatctgggcgatttgatgcgctattacgagctgttcgaggacccggcggcgctgcgcggcattttgaagggcatgtactgggtattcggggaaaatccgtggaatatcagctgggtttcgggcatcggcgaggatcatgtcgacttcctgcatacccgcttcgacgaggaagcgaacacggcgacgggcaaagggatcgtcatccccggcgcgatggtcagcggcccgaatatgaaggatcctaaagacaagcgcagcgtcagcccttggtatgaggaccgttcgctccacagcgacgataccagccagtggcggtacaacgagtacagcatcagcattcaggccgggctgctctatacgattatggggctgagcgccgtcgatacgtcaggcgcttccgaggtcgcgtacccggcagagctgccgattctctcccccgtcatcggcgattatgtgaggggccaggtgaccgtgttcgcggaggcgcctgccgaaattgtcgctgcggattatacggcgggatcgggctacagcgccatgacgaaaaccggcggcatctataccggaacggtcgacgaaagcgcgacggctccgttcatcaaccggagagtcgacgtgcggggaagcgacggcaacggcaatttcacctacagctcgacgcattatacggttgcgccgccgctgcccggtccgtccacgccgctgctgtacgacgatttcggcggaggcggactgtggggttcgacgggcggcaacaatcagtgggtgaactggtacacccagaacggcggcacggccaccttcgcgaagacgacggaagacggccgcacggtcggcaaattcacgcagacgccggcctccgccagctcgaacgccaagttccagccatggcatgacgccgtcgacctgtcgggctaccgttatgtgaacgtcaccgtgaaaaatccggctcatccggatctgcggatgcgaatcgagctgtcggacggcagccgcacgtacaacctgaccggcggttggataaccgtaccggcggagtggaccgatctgcagttcgatctggacgcgctcgtgccgaaggtgaacaagcaggcggcgaagttctcgctatggcttaaccaaagcaccggcagctacggcgaaatgttcgtcgacgagtggaaagcgaccaacgccgccagcggcagcgcgccgacgctcaccgatgccggcgtggaccaggcttccggcgacccggacaccgatttcacgttcagcgtcacttatacggatgccgacaacgagccgcctttcgccatggagctcgtcctgaacggggtcgttcacacgatgcagcctgtcgacgcgagcgataccaactatgccgacggcaagcagtatcaatacatgacgaagctgcatccgggcgcgcacacctactacttccatacgaccgacacgtcctcggatgcggtgagcacaccggtcctgaccgggccgaccgtgagccgggcgctctctaacgagctcttccacgacgattttgaggacggcgacgcggccggctggatcccgacgagcggaacctgggccgtcgagaacggtcaataccgcgggcaggccggctccggccagagcctctcgctcgccggcgacgcagcctggaccgattacgaactgcgggctagagtgaacatcaccaacaatacgaacggcaataaagacgccggattggtgttccgttacacggacgacaacaactactatatcctgtacctgaagaataacgaccggccggggcgcaagatggagctggtcaaagtcgagaacggcgtgaagacgacgctcgcctttgcgaacccgagcattgcggcggatacgtactatacgtatcggattgtcgccagcagtagcgccatcgaagcctacaaggatggcgtcctcgaagtgagcgccaccgacagcgcccacagcgccggcaaaatcggcctgcgcgtctacgccaacaccagggcctacttcgacgacgtgaccgtcacgccaagttag

SEQ ID NO: 100 - protein, 1407 aa, Artificial Sequence
  Synthetic Construct
MKKPLGKIVASTALLISVAFSSSIASAHHHHHHPRAVPPLPNPSNPLVYDDFAGGGVFKQNWMNWYNQDGGVGAFSKTTVDGRSVGVFAQTPASGSSWAKFQPWNETVDLTGYRYLNFMLKNPGYPDARVRLVVNDGARSYNLTNGWAEVPDDWTLYQYDMDALTPPINKKTARFEIWLRQTSGAYGEILFDDISAVTASTGTQPTLTNTGLSFNSDNIHTQNTRYTFYATYTDADNEKPFAMQVIIGDTAYDMKETDYTDTNYTDGKGYTYTTKLPVGSHPYYFRATDTTSDVVVTPVQAGPTVVYSEQAIDVVVSQAGYGANDYKSAKVTAKLPLGDTAFEVWNGSSVAAAGNLVYEGFVWDKHVYTAEFSSVTAPGNSYTVRSNGFSSYAFPIQPNIWDSYKDEMTAFYRIQRASVATADVYPPGYSTVPPSPKVFHPAGHLDDAASPDGTVHYDLTGSWYDAGDYGKYGGNQWVGAQIALAYIRHAEAPSVKFDNDNNGIPDLVDEAVFGSEYLIKFANQLGGAMYNIKNNASFVHPHKSTDNIPGTADDRKLVDYGIGGSAKAAGTLAATARAIHKAIAEGDIEPAKTAQLSAFAAECEAAAVTFYNYVLAHPNDPIGSYSTRGGIANSMLLAQVQLYLLTNDTAYRDAAAAEINSLTFDDLYATNYWDMRPMSMAEFYPVADPATQAHIHSLLKQQVDYFLSSTDDTPYGVLNQFKNFGVNEPHVSYLGDLMRYYELFEDPAALRGILKGMYWVFGENPWNISWVSGIGEDHVDFLHTRFDEEANTATGKGIVIPGAMVSGPNMKDPKDKRSVSPWYEDRSLHSDDTSQWRYNEYSISIQAGLLYTIMGLSAVDTSGASEVAYPAELPILSPVIGDYVRGQVTVFAEAPAEIVAADYTAGSGYSAMTKTGGIYTGTVDESATAPFINRRVDVRGSDGNGNFTYSSTHYTVAPPLPGPSTPLLYDDFGGGGLWGSTGGNNQWVNWYTQNGGTATFAKTTEDGRTVGKFTQTPASASSNAKFQPWHDAVDLSGYRYVNVTVKNPAHPDLRMRIELSDGSRTYNLTGGWITVPAEWTDLQFDLDALVPKVNKQAAKFSLWLNQSTGSYGEMFVDEWKATNAASGSAPTLTDAGVDQASGDPDTDFTFSVTYTDADNEPPFAMELVLNGVVHTMQPVDASDTNYADGKQYQYMTKLHPGAHTYYFHTTDTSSDAVSTPVLTGPTVSRALSNELFHDDFEDGDAAGWIPTSGTWAVENGQYRGQAGSGQSLSLAGDAAWTDYELRARVNITNNTNGNKDAGLVFRYTDDNNYYILYLKNNDRPGRKMELVKVENGVKTTLAFANPSIAADTYYTYRIVASSSAIEAYKDGVLEVSATDSAHSAGKIGLRVYANTRAYFDDVTVTPS

SEQ ID NO: 101 - DNA, 2844 bp, Paenibacillus sp
  CDS (1)..(2841)
  sig_peptide (1)..(75)
  mat_peptide (76)..(2841)
atgattcgacgacgaacgacactctggatcggcggtgcgacgaccgtcgccctcgctgcgggaggggtgatcgccgcgacacccgctctcgcggcgaccgtgaaacaggtggcggtgagccaggccggctacagcgcatcaggcctcaaagtgggttccgtcgtcgtggacggcgacctcgaccccggcgcgtcctgccgcatccttcaggggacgacggctgtggtgcccgcgtgcacgctcgcagacgccggaacggtgtggggcgaccacgtgtacacggtcgacttctccggcctcgcgacgctcggcgaggactacgtgctggaggtcgacggcaccgcatccccccgcttcgcgatccgtgacaacgtctggtcggggtacctcgacgagatgacggcgttctatcgcttgcagcgctcgggcgtcgccaccgccgacgtctacccggacggctacagcagcatcgcgccgtcggccaagatcttccacggcccgggccatctcgacgacgccgcgtccgaggacggtactgtccactacgacctcacgggcgggtggtacgacgccggcgactacggcatctacggcggcaaccagtgggtcggggggaacatcgccatcagctacctccgttacggcgacaccccggcggtcgccttcgacaacgacgccaacggcgtgcccgacctcgtggacgaggcgcgtttcggcagcgagtacctccttcggatgtgggatgccttcgacggggcgttctgggacgtcaagggcagcggcggcttccagcatcccgacaagcacaccgatggcatcgtcggaacaaaggacgacaggcggatctccggctacggggtcggcggctccgcgaaggccgcgggcaccctcgccgcaacggcccgcgcggtggacaaggcccttgccgacggtgcgatcccgtccgccgacgtcgccgagtggcaggcgttctcggcgcaggcacgcaccggcgcggaaggcttctacacctatgccgatgcgcaccggacggacccgctcggcgggtactcgaccacacgcggcgggatcgacaactcgctgctgttcgccgaggtcgagctgcacctgctgaccggcgacacctcgtatcgggatgccgcggagagcaccatcgcggccacggacttcaccatcctgtcgaacacgaactactgggaccttgcgcctctctcgatggccgagctctaccccgtggcgacacccacggcccaggggcagatccacgcgtacctcgagaagcagctggactacttcctgtcgagcaccgacgacacgccctacggcgtcatgaaccagttcaagaacttcggggtcaacgaaccgcacgtctcctacgtggccgacgccctgcgctactacgagctgttcggcgacgagcgcgccctccgcgccgtccagcgagggctgtactgggtgttcgggaacaacccctggggcacgagttgggtgtccggcgtgggcgagaagagcgtgaagttcctgcacacgcgcctcgacgaggatgcccagaatcaggcgggcacgggagtcgtcgtaccgggcgcgctggtcagcggcccgaacgcccgagacccgctcgacgtccgcagcgccagcccgtggtacgtcgaccgcccggtgtggcaggacagcgggcagcagtggcgctacaacgagtacagcgtcagcatcgaggcggggctgttctcggcgttgttcggcctcaccgccgtcggcgatgcgccgtggtccgggggaaccgccccggccgcgctgaacgtcacctcgccccggatcggcgacgaggtcacgggagacgtcaccgtcttcgccgagagcgatctcggttctcccgccctcggaccgaattggtcgcccatgacggtggcgggcggcgtcgcgaccggcgtcttcaacgtcgacagcgccgccccgttcacgaatgcacgggtggacgtgcgcggcacgcaaaccgacggggcacaggtgtactcgtcgacgcactacaccgtggcccctcccctgccgacgccgcagagccccctgctgtacgacgggttcggcaaggacggcctgttcggcgtccagggctacacatgggccaactggtacaacaaccacgccggtgtgggttccgtgaccaacacgacgatcgacgggcgcacggtcggaaggttcttccagaaccccgcgaccgcggcatcccaggcgaagttccagccgtggcaccacgccgcggacgccagcggttaccgctacctgagcgtcacgatgcgctcgccctcgcccaacctgcgcttgcgcatcgaggtctccgacgcggactcgaaccaccgcgtcacgggtaatgcgcccatcgccgtgtcgaacacgtggaacacgtactcgttcgacctcgcggccttccccggcctcgatcggtcgcaggcgaagatcgtcttctggctgcagcagacggctgacaccgacggggagttgttcgtcgacgacgtgagcttcaccaaccaggcgacaggcactgcgccgacgctcacggcgatctcgcacaccggcgggccgctcaccgccgacgacgacgtgaccgtgcaggcgacgtacacggatgccgacgggcaggcgccgcacaaggtcgagctcgtgctggacggggtggtgcacgacatggcaccggtggatccgtccgacacggtcgtgaccgatggcgcggtctacgcggtcaccagccgatgggtgaagggcgtgcacagctactccgtgcgcaccaccgacaccacatcggccgtggtgacctcggcgacgacgacgggcatcctcgtccagtga

SEQ ID NO: 102 - protein, 947 aa, Paenibacillus sp
MIRRRTTLWIGGATTVALAAGGVIAATPALAATVKQVAVSQAGYSASGLKVGSVVVDGDLDPGASCRILQGTTAVVPACTLADAGTVWGDHVYTVDFSGLATLGEDYVLEVDGTASPRFAIRDNVWSGYLDEMTAFYRLQRSGVATADVYPDGYSSIAPSAKIFHGPGHLDDAASEDGTVHYDLTGGWYDAGDYGIYGGNQWVGGNIAISYLRYGDTPAVAFDNDANGVPDLVDEARFGSEYLLRMWDAFDGAFWDVKGSGGFQHPDKHTDGIVGTKDDRRISGYGVGGSAKAAGTLAATARAVDKALADGAIPSADVAEWQAFSAQARTGAEGFYTYADAHRTDPLGGYSTTRGGIDNSLLFAEVELHLLTGDTSYRDAAESTIAATDFTILSNTNYWDLAPLSMAELYPVATPTAQGQIHAYLEKQLDYFLSSTDDTPYGVMNQFKNFGVNEPHVSYVADALRYYELFGDERALRAVQRGLYWVFGNNPWGTSWVSGVGEKSVKFLHTRLDEDAQNQAGTGVVVPGALVSGPNARDPLDVRSASPWYVDRPVWQDSGQQWRYNEYSVSIEAGLFSALFGLTAVGDAPWSGGTAPAALNVTSPRIGDEVTGDVTVFAESDLGSPALGPNWSPMTVAGGVATGVFNVDSAAPFTNARVDVRGTQTDGAQVYSSTHYTVAPPLPTPQSPLLYDGFGKDGLFGVQGYTWANWYNNHAGVGSVTNTTIDGRTVGRFFQNPATAASQAKFQPWHHAADASGYRYLSVTMRSPSPNLRLRIEVSDADSNHRVTGNAPIAVSNTWNTYSFDLAAFPGLDRSQAKIVFWLQQTADTDGELFVDDVSFTNQATGTAPTLTAISHTGGPLTADDDVTVQATYTDADGQAPHKVELVLDGVVHDMAPVDPSDTVVTDGAVYAVTSRWVKGVHSYSVRTTDTTSAVVTSATTTGILVQ

SEQ ID NO: 103 - DNA, 2856 bp, Artificial Sequence
  Synthetic construct
  CDS (1)..(2853)
  sig_peptide (1)..(81)
  mat_peptide (82)..(2853)
atgaagaaaccgttggggaaaattgtcgcaagcaccgcactactcatttctgttgcttttagttcatcgatagcatcagcacatcatcatcaccatcatcctagggcaacagtcaaacaagtagcagtgtcacaagcgggatacagcgcgtcaggattaaaggtcggatcggtggttgttgacggagacctggaccctggtgcttcctgccggattctgcagggaacgacagcagtagttccagcgtgtacccttgcggatgctggcacggtgtggggagatcatgtatacacagtcgacttctccggtcttgcgacattaggggaagattatgtcctggaagtcgatggaaccgcgagtccgcgctttgcgattcgcgacaatgtttggtcaggttatttagatgaaatgactgctttctaccgtcttcagagatctggcgtcgctactgcagatgtttacccggatggttattcatctattgccccgtctgcaaaaatatttcacggaccagggcatcttgacgatgcagcaagtgaagatggcactgtgcattacgatttaacggggggctggtatgatgctggagattacggtatttacggaggaaaccaatgggtcggcggcaacatagctatctcttacttacgctacggagacactccagctgtcgcgtttgataatgatgctaatggagtacctgaccttgtggatgaagcacggttcggaagcgagtatttgttacgaatgtgggacgccttcgatggggcattttgggatgttaaaggcagcggtggatttcaacaccctgataaacatacagatggcatagttggtacaaaagacgatcggcgcataagcggatatggagttggaggttctgcgaaagcggctgggacccttgcggcgacggcacgcgcagtggataaagcgcttgcagatggagctattcctagcgcagatgttgcagaatggcaggctttctcagctcaggctcgtacaggtgcggagggcttctatacatatgctgacgctcacagaacagacccgttaggaggatactcaactacacggggaggtattgacaattcacttttatttgcagaagtagaattacatctgcttactggagacactagttatcgagatgccgccgaatcgacaattgcagccacggattttacaattttgtcaaatacgaactattgggatttagccccactctcaatggcggagctgtatccagtcgccaccccaaccgctcaggggcagatccacgcatacctggaaaaacagctggattactttctttctagtactgatgatacgccatatggtgtcatgaatcaatttaaaaacttcggcgtcaatgaaccgcatgtatcatatgttgccgatgcgctgcggtattatgaacttttcggtgacgaaagagcgctgcgtgctgtgcagcgcggcctttattgggtcttcgggaataatccgtggggcacttcctgggtgtcgggcgtcggcgagaaatcggtaaaatttttgcatacaagacttgatgaagatgcgcaaaatcaggctggtacaggcgtagtcgtcccaggagcattggtctctggcccgaatgctcgcgaccctttagacgttcgcagcgcatcaccgtggtatgtggatagaccggtttggcaggattcagggcaacaatggcgctacaacgaatactccgtttcaattgaagcaggactgtttagtgcgttattcggattgactgcagtaggagatgcaccgtggtcaggcggcaccgcacctgccgcgttaaatgtgacttctccgcgtatcggtgatgaagtcacaggagatgtcaccgtcttcgctgaatctgatttaggctctccggcgttggggccaaattggtctccgatgacagtcgcgggaggagttgcaacaggtgtgttcaacgtggactccgcagcaccatttactaatgccagagtggatgttcgtggcacgcagacagatggtgcacaagtatatagctctacgcattataccgttgctcctccgctgcctacaccgcaatcaccacttctctacgacggatttgggaaagatggcttgttcggggtccaaggatacacctgggctaactggtacaataaccatgctggcgttggtagcgttacaaacacgactatagatggtcggacagtgggccgattttttcaaaatccagcgaccgcggcatcgcaggccaaattccaaccgtggcatcatgcggcagacgcatcagggtaccgataccttagcgttactatgcgctcaccgtcgcctaatctccgccttcgcattgaagttagcgacgcggacagcaaccatcgagttacaggcaatgcaccaattgctgtttctaatacgtggaacacctatagtttcgacttagccgcatttcctggtcttgatcgctcgcaagcgaagatcgttttttggcttcagcaaacagccgatactgacggtgagctttttgtagatgacgtcagctttacgaatcaggcgacgggtactgctccaacccttacagcaatcagccatacaggcggtccacttacagcggacgacgatgtgacagtccaggcgacatacacggatgcagacggccaggcgccgcataaagttgagcttgtacttgacggagtggtacatgatatggcgcctgtagacccttctgataccgtagtgacagatggcgcagtctatgcggtcacatctcgctgggtaaaaggcgtgcattcatattcagttcgcacgaccgacacaacaagtgctgtcgttacatccgctacaacgacgggcattttggtccaataa

SEQ ID NO: 104 - protein, 951 aa, Artificial Sequence
  Synthetic Construct
MKKPLGKIVASTALLISVAFSSSIASAHHHHHHPRATVKQVAVSQAGYSASGLKVGSVVVDGDLDPGASCRILQGTTAVVPACTLADAGTVWGDHVYTVDFSGLATLGEDYVLEVDGTASPRFAIRDNVWSGYLDEMTAFYRLQRSGVATADVYPDGYSSIAPSAKIFHGPGHLDDAASEDGTVHYDLTGGWYDAGDYGIYGGNQWVGGNIAISYLRYGDTPAVAFDNDANGVPDLVDEARFGSEYLLRMWDAFDGAFWDVKGSGGFQHPDKHTDGIVGTKDDRRISGYGVGGSAKAAGTLAATARAVDKALADGAIPSADVAEWQAFSAQARTGAEGFYTYADAHRTDPLGGYSTTRGGIDNSLLFAEVELHLLTGDTSYRDAAESTIAATDFTILSNTNYWDLAPLSMAELYPVATPTAQGQIHAYLEKQLDYFLSSTDDTPYGVMNQFKNFGVNEPHVSYVADALRYYELFGDERALRAVQRGLYWVFGNNPWGTSWVSGVGEKSVKFLHTRLDEDAQNQAGTGVVVPGALVSGPNARDPLDVRSASPWYVDRPVWQDSGQQWRYNEYSVSIEAGLFSALFGLTAVGDAPWSGGTAPAALNVTSPRIGDEVTGDVTVFAESDLGSPALGPNWSPMTVAGGVATGVFNVDSAAPFTNARVDVRGTQTDGAQVYSSTHYTVAPPLPTPQSPLLYDGFGKDGLFGVQGYTWANWYNNHAGVGSVTNTTIDGRTVGRFFQNPATAASQAKFQPWHHAADASGYRYLSVTMRSPSPNLRLRIEVSDADSNHRVTGNAPIAVSNTWNTYSFDLAAFPGLDRSQAKIVFWLQQTADTDGELFVDDVSFTNQATGTAPTLTAISHTGGPLTADDDVTVQATYTDADGQAPHKVELVLDGVVHDMAPVDPSDTVVTDGAVYAVTSRWVKGVHSYSVRTTDTTSAVVTSATTTGILVQ

SEQ ID NO: 105 - DNA, 2802 bp, Paenibacillus sp
  CDS (1)..(2799)
  sig_peptide (1)..(96)
  mat_peptide (97)..(2799)
atgaaaaggcgattgtggaggagcggattggcggcattgatattgctattggtattttctgccttgggctcgtggacaccgggaaaagcgcatgcggcagacgaattcgatgcaatgagggagaactggaagacgatgctcacgggcggatcggggttggatacactggatccggatatcgcggcggccacggtaaagcttgccggcgaggcaaacgggtattggtcgagcatgagcgtgagtcccacaaggacgtttctgtggagcaacatagcgagcgtagggaactccgttcatatcaggcaaaattatgagcggctgaaggtcatggcgctggcgtacgctacgccaggctcttccctctacggggacgccgtacttgagagcgatatcgtaggggcgctggattacatgtacgccacacgttatcacgagaacgtcacgacgacgccaagcggtacaagcaactggtgggattggcagatcggcatccctgtgcaattaaacgatattgtcgtcctgatgtacgatgtcctcagctccacgcaggtcgccaattatgcggcagccgtggagcgatttactccggccgtaacgctgacaggagccaaccgttcctggaaggcgcaggtcgtcggtattcgcggggtattggtaaaggatccagtgaagcttgaggcgacgagagacggcatgtcccaaatttttgattatgtcgtacaaggcgacggcttctacgcggacggctcattcgtccagcattcgacctttgcttatacgggagggtacgggctgcctctaatcaaagccataggcgacctgctgggattgctgcaaggcacgacctggcaagtaacggatcccgatctggccaacgtctggggctgggtatacgatgcgtatcagccgctcatctacaaaggagccatgatggataacgtgcgcggccgagaaatttcgcgagagtacatgcaggatcacgatgccggacacgatgcgatccggagcattctgagattggcgcaaattgcgccggctcagcaagcggcagacttcaagagtatggttaaagcgtgggttgcggaggatacgtttcaaagcttctacgaatttgcgccggtgcctatggtggggctggccaaggagctggccgtcgatcccgcggtgactcccgccgaggaattgcttctgtacaaacagtacgcgggcatggaccgggccgtacagcttcgtcccggctacggattcgggcttggaatgtattccaagcgaatctcgacctatgaagctatcaacaacgagaaccataaaggttggtatacgagcgcaggcgtagcgaatctgtataacgccgatctggggcaatacagcgacggttattggccgacggtcaacagctaccgtttaccgggcacgactatattgtcggcaacgggcgtcggcaatcatcgcagcgtcaataattggacgggaggcactgaaatgtccgggttgtacggcatatccggaatggacctggcttacagcggcaaggcgcttagtgcacgcaagtcgtggtttatgtttgacgacgagatcgtggcgctcggcgcaggcatctcgagcacggacggcattgcagtcgagacgatcgtggaaaaccgcaagctgagcagtgccgggggagaggcacttactgtaaacggcgtggctcagtcgtctctattgggctggaacgatacgctgactggcgtgcaatgggcgcatctggcaggaagcgtgccaggctccgatatcggctactacttcccgcaaacgtctgacattaaggcgctcagagaggcgcgcacgggcaagtggagtcagatcaacacacgtccgggcacgccgggcggcaacattacacgcaactacatgacgatgtggttcgatcatggaagcaatccttcgggcgccagctacgagtacgtgcttctgcctaaccagacaagcgcgggcgtggcggcgtacgctgcgaatccttccgtggaagtggtggccaatacggtcgacgttcaagcggtgaaggatactgcgcttggcatcgtaggcgcgaatttctggagcgacggcactctggaagcggatttcattcaatccaataagaaagcttccgtcatgacaaaggagtcgtcggatggggagacgcttgaattgtccgtcagtgatcccactcaggtcaatacgggtacgatccaactggagctggatcgctccgccttgtcgtacagcgccgatcctggcattacggtaacgcaactgagtcctacgattaagctgacggtaaacgtcaacttggctagaggcaagacgtttaaagcatcattccagttgggagaggaccctgaccctgaacccgaacccgagccgacaccggagccggttatcgtcgacaatcttgatactggcgcatcgctggtaggtacttggttggtttcgtcggctgagacggatcgttatggctccaactatattcatgacaacaaaaccggcaaaggagtcaattccgtgacattcgctgccaccctgccggtgacgggcacctacacggtatccatgatgtgggcggatcatttcaatcgcgcttcgtatattcctgttgatatcgtctacgatggcggatctacgacggtatacatcgaccagaggacaggtgggggcgtatggaatccgctggggacgttcaccttcgacgccgttgccggaggaagcgtgactattcgtaccgacggcacgacgggctatgtcgttgccgatgcggtcaagtttgaattcgtgccgtaa

SEQ ID NO: 106 - protein, 933 aa, Paenibacillus sp
MKRRLWRSGLAALILLLVFSALGSWTPGKAHAADEFDAMRENWKTMLTGGSGLDTLDPDIAAATVKLAGEANGYWSSMSVSPTRTFLWSNIASVGNSVHIRQNYERLKVMALAYATPGSSLYGDAVLESDIVGALDYMYATRYHENVTTTPSGTSNWWDWQIGIPVQLNDIVVLMYDVLSSTQVANYAAAVERFTPAVTLTGANRSWKAQVVGIRGVLVKDPVKLEATRDGMSQIFDYVVQGDGFYADGSFVQHSTFAYTGGYGLPLIKAIGDLLGLLQGTTWQVTDPDLANVWGWVYDAYQPLIYKGAMMDNVRGREISREYMQDHDAGHDAIRSILRLAQIAPAQQAADFKSMVKAWVAEDTFQSFYEFAPVPMVGLAKELAVDPAVTPAEELLLYKQYAGMDRAVQLRPGYGFGLGMYSKRISTYEAINNENHKGWYTSAGVANLYNADLGQYSDGYWPTVNSYRLPGTTILSATGVGNHRSVNNWTGGTEMSGLYGISGMDLAYSGKALSARKSWFMFDDEIVALGAGISSTDGIAVETIVENRKLSSAGGEALTVNGVAQSSLLGWNDTLTGVQWAHLAGSVPGSDIGYYFPQTSDIKALREARTGKWSQINTRPGTPGGNITRNYMTMWFDHGSNPSGASYEYVLLPNQTSAGVAAYAANPSVEVVANTVDVQAVKDTALGIVGANFWSDGTLEADFIQSNKKASVMTKESSDGETLELSVSDPTQVNTGTIQLELDRSALSYSADPGITVTQLSPTIKLTVNVNLARGKTFKASFQLGEDPDPEPEPEPTPEPVIVDNLDTGASLVGTWLVSSAETDRYGSNYIHDNKTGKGVNSVTFAATLPVTGTYTVSMMWADHFNRASYIPVDIVYDGGSTTVYIDQRTGGGVWNPLGTFTFDAVAGGSVTIRTDGTTGYVVADAVKFEFVP

SEQ ID NO: 107 - DNA, 2811 bp, Artificial Sequence
  Synthetic construct
  CDS (1)..(2808)
  sig_peptide (1)..(81)
  mat_peptide (82)..(2808)
atgaagaaaccgttggggaaaattgtcgcaagcaccgcactactcatttctgttgcttttagttcatcgatagcatcagcacatcatcatcaccatcatcctagggcagacgaattcgatgcaatgagggagaactggaagacgatgctcacgggcggatcggggttggatacactggatccggatatcgcggcggccacggtaaagcttgccggcgaggcaaacgggtattggtcgagcatgagcgtgagtcccacaaggacgtttctgtggagcaacatagcgagcgtagggaactccgttcatatcaggcaaaattatgagcggctgaaggtcatggcgctggcgtacgctacgccaggctcttccctctacggggacgccgtacttgagagcgatatcgtaggggcgctggattacatgtacgccacacgttatcacgagaacgtcacgacgacgccaagcggtacaagcaactggtgggattggcagatcggcatccctgtgcaattaaacgatattgtcgtcctgatgtacgatgtcctcagctccacgcaggtcgccaattatgcggcagccgtggagcgatttactccggccgtaacgctgacaggagccaaccgttcctggaaggcgcaggtcgtcggtattcgcggggtattggtaaaggatccagtgaagcttgaggcgacgagagacggcatgtcccaaatttttgattatgtcgtacaaggcgacggcttctacgcggacggctcattcgtccagcattcgacctttgcttatacgggagggtacgggctgcctctaatcaaagccataggcgacctgctgggattgctgcaaggcacgacctggcaagtaacggatcccgatctggccaacgtctggggctgggtatacgatgcgtatcagccgctcatctacaaaggagccatgatggataacgtgcgcggccgagaaatttcgcgagagtacatgcaggatcacgatgccggacacgatgcgatccggagcattctgagattggcgcaaattgcgccggctcagcaagcggcagacttcaagagtatggttaaagcgtgggttgcggaggatacgtttcaaagcttctacgaatttgcgccggtgcctatggtggggctggccaaggagctggccgtcgatcccgcggtgactcccgccgaggaattgcttctgtacaaacagtacgcgggcatggaccgggccgtacagcttcgtcccggctacggattcgggcttggaatgtattccaagcgaatctcgacctatgaagctatcaacaacgagaaccataaaggttggtatacgagcgcaggcgtagcgaatctgtataacgccgatctggggcaatacagcgacggttattggccgacggtcaacagctaccgtttaccgggcacgactatattgtcggcaacgggcgtcggcaatcatcgcagcgtcaataattggacgggaggcactgaaatgtccgggttgtacggcatatccggaatggacctggcttacagcggcaaggcgcttagtgcacgcaagtcgtggtttatgtttgacgacgagatcgtggcgctcggcgcaggcatctcgagcacggacggcattgcagtcgagacgatcgtggaaaaccgcaagctgagcagtgccgggggagaggcacttactgtaaacggcgtggctcagtcgtctctattgggctggaacgatacgctgactggcgtgcaatgggcgcatctggcaggaagcgtgccaggctccgatatcggctactacttcccgcaaacgtctgacattaaggcgctcagagaggcgcgcacgggcaagtggagtcagatcaacacacgtccgggcacgccgggcggcaacattacacgcaactacatgacgatgtggttcgatcatggaagcaatccttcgggcgccagctacgagtacgtgcttctgcctaaccagacaagcgcgggcgtggcggcgtacgctgcgaatccttccgtggaagtggtggccaatacggtcgacgttcaagcggtgaaggatactgcgcttggcatcgtaggcgcgaatttctggagcgacggcactctggaagcggatttcattcaatccaataagaaagcttccgtcatgacaaaggagtcgtcggatggggagacgcttgaattgtccgtcagtgatcccactcaggtcaatacgggtacgatccaactggagctggatcgctccgccttgtcgtacagcgccgatcctggcattacggtaacgcaactgagtcctacgattaagctgacggtaaacgtcaacttggctagaggcaagacgtttaaagcatcattccagttgggagaggaccctgaccctgaacccgaacccgagccgacaccggagccggttatcgtcgacaatcttgatactggcgcatcgctggtaggtacttggttggtttcgtcggctgagacggatcgttatggctccaactatattcatgacaacaaaaccggcaaaggagtcaattccgtgacattcgctgccaccctgccggtgacgggcacctacacggtatccatgatgtgggcggatcatttcaatcgcgcttcgtatattcctgttgatatcgtctacgatggcggatctacgacggtatacatcgaccagaggacaggtgggggcgtatggaatccgctggggacgttcaccttcgacgccgttgccggaggaagcgtgactattcgtaccgacggcacgacgggctatgtcgttgccgatgcggtcaagtttgaattcgtgccgtaa

SEQ ID NO: 108 - protein, 936 aa, Artificial Sequence
  Synthetic Construct
MKKPLGKIVASTALLISVAFSSSIASAHHHHHHPRADEFDAMRENWKTMLTGGSGLDTLDPDIAAATVKLAGEANGYWSSMSVSPTRTFLWSNIASVGNSVHIRQNYERLKVMALAYATPGSSLYGDAVLESDIVGALDYMYATRYHENVTTTPSGTSNWWDWQIGIPVQLNDIVVLMYDVLSSTQVANYAAAVERFTPAVTLTGANRSWKAQVVGIRGVLVKDPVKLEATRDGMSQIFDYVVQGDGFYADGSFVQHSTFAYTGGYGLPLIKAIGDLLGLLQGTTWQVTDPDLANVWGWVYDAYQPLIYKGAMMDNVRGREISREYMQDHDAGHDAIRSILRLAQIAPAQQAADFKSMVKAWVAEDTFQSFYEFAPVPMVGLAKELAVDPAVTPAEELLLYKQYAGMDRAVQLRPGYGFGLGMYSKRISTYEAINNENHKGWYTSAGVANLYNADLGQYSDGYWPTVNSYRLPGTTILSATGVGNHRSVNNWTGGTEMSGLYGISGMDLAYSGKALSARKSWFMFDDEIVALGAGISSTDGIAVETIVENRKLSSAGGEALTVNGVAQSSLLGWNDTLTGVQWAHLAGSVPGSDIGYYFPQTSDIKALREARTGKWSQINTRPGTPGGNITRNYMTMWFDHGSNPSGASYEYVLLPNQTSAGVAAYAANPSVEVVANTVDVQAVKDTALGIVGANFWSDGTLEADFIQSNKKASVMTKESSDGETLELSVSDPTQVNTGTIQLELDRSALSYSADPGITVTQLSPTIKLTVNVNLARGKTFKASFQLGEDPDPEPEPEPTPEPVIVDNLDTGASLVGTWLVSSAETDRYGSNYIHDNKTGKGVNSVTFAATLPVTGTYTVSMMWADHFNRASYIPVDIVYDGGSTTVYIDQRTGGGVWNPLGTFTFDAVAGGSVTIRTDGTTGYVVADAVKFEFVP

SEQ ID NO: 109 - DNA, 2796 bp, Paenibacillus sp
  CDS (1)..(2793)
  sig_peptide (1)..(96)
  mat_peptide (97)..(2793)
atgaagcggtcatgggtgaagggcggtttgatcggtatgattatgctgctggcattcagcttggcgggaggagtggggcctcagcggattttcgcgtcagatgaatatgatacgatgcgggaaaaccgcaaggcgatgcttaccggaggggcaggcttgaatatggctgatgcagatattgcggcagcggtagcggcactggcggcagaggcagacggttactggcaatcaatgaataaggctgcgggacgaacagctctatggagcgatcagcaaggcgtcggcaactccattcatattcgcatcagctatgaacggctgaaccggatggcgctggcgtacgcgaccgaaggctcagcgctttatggtcatacggcgcttgccgacgatctggtcagtgcgctggatttcatgtatgccactaggtatcatgagcttgtcactacgactccgagcgggacaagcaattggtgggactggcagatcggcattccgatgcagcttaatgatgcggttgtgcttatgtacgacgacttaagcacgacacagatccatcattatatgaaagcggtggaacgcttcacgcccgtcgtcaatctgactggtgcgaatcgttcctggaaagcgatggtcgtggcgatcagaggaatcattgttaaggacggagtcaaaatcgccgctgcccgtgatgggctgtcgcaaatctttccttatgtggtgagcggagacggcttctatcgcgatggctctttcatccagcatagtacgattccgtatacaggcggctatgggcttgatctactgctggctgtaagcgatctgttggctgtgctgcacggatcgacctggcaggtgaccgatccgaaccacgcgaatgtgtgggactgggtgtatcaagcgtatcagccgctcatctacaagggagccatcatggatatggtgcgcggccgggagatatccaggcactacaggcaggatcacgctgcaggccatgtagctattcagggcatcctgctgctgtcggaggcggctccggctgtacaagcggcagactttaaacggatggtcaaaggctgggtgcaggcggatagctatttgtccttctattcggatgcgccggtctcttccatcgtcagggccaaggccattgcagccgatccgctcattttgccagccgatccgcttatcgggtataagcaatatgccggcatggacagagcggtacagcaccggccggattacagcgcaggattagccatgtattcaagccgcacaaacagctttgaagcgatcaacagcgagaacggcaaggcctggtatacctcagcaggaatgcttagcttgtataataacgatttgggacaatacagcgaggacttctggccaacggtcgactcttatcgcttgcctggcacgacggtcctgtcgcaaacgccgtctgcgagtcacaaaagcgctaatgcctggacgggaggaaccgatatgctaggtcagtacggcgtttccggtatggaccttcaggatgccaaccacacgcttggcgcccgtaaatcctggtttatgttcgatgacgaaatggttgctctcggtgcgggaatcaccagcacggacagcatagcggctgaaaccattgtggagaaccgaaagctgagcggcgcaggcaatgagacactgaccgttaacggcactgtacagccagcatcgctcggctggtcgtcgacattgagcagcgtggagtgggcacatttggcaggctccgctccgggctccgatattggctattacttccccggtgggacgagccttgaagcgaagcgggaagcgagaaccggcaattggaaacagattaacacgcgtccggtaacgcctgcgactccaatcacacgctcctacatgacgatgtggctgaaccacggcacaaatccgacggatgcggcctatgaatatgtactgctgccgaacaaatcgagcgccgaggtagctgcatatgctgcagattcgcatgttcaggtgctggcaaattcagccgaggtgcaggcggtgagagagaagacgcttaacttgatcggcgcgaacttctggaccgacagcctgcaaagcgtggattttatcacagtgaacaaaaaggcaaccgtgatgacgaaggagtcggcagagggtagtctcgacctgtcgatcagcgatccgacccagcttggtacgggctatatcgaggttgagcttgaccgtactgccgagagctttaccgctgatgccgggatttcggtgacgcagctaagtccgacgatcaagctaagggtcaataccaatctggcgcgtggcaaaagctttaaggcgtccttccagctaggggaggacgtgccgcctgttacctatgaagatgtgattgtcgataacaatgatacggcgtttgttgccaagacgggaacatggaagacggcatcaacgcaaacggatcgttatggaagtaattacctgcatgacgataatgctggcaaggggaccaaaagcattacgtttaccccggatttgccagtgtcgggaacgtacagggtatacatgatgtggccgcagcatgccaaccgctcgatcgctgtgcccttatccataggacatgcggcaggtacagcatcattaacggttaatcagacggcaaacgggggaatatggaatctgcttggcaccttcacgtttgacgaaggagagcatggagccatcacgctaggcaatgagggcacaagcggctatgtgactgccgatgctgtgaggtttgaatatgtggcgccaggctcttag

SEQ ID NO: 110 - protein, 931 aa, Paenibacillus sp
MKRSWVKGGLIGMIMLLAFSLAGGVGPQRIFASDEYDTMRENRKAMLTGGAGLNMADADIAAAVAALAAEADGYWQSMNKAAGRTALWSDQQGVGNSIHIRISYERLNRMALAYATEGSALYGHTALADDLVSALDFMYATRYHELVTTTPSGTSNWWDWQIGIPMQLNDAVVLMYDDLSTTQIHHYMKAVERFTPVVNLTGANRSWKAMVVAIRGIIVKDGVKIAAARDGLSQIFPYVVSGDGFYRDGSFIQHSTIPYTGGYGLDLLLAVSDLLAVLHGSTWQVTDPNHANVWDWVYQAYQPLIYKGAIMDMVRGREISRHYRQDHAAGHVAIQGILLLSEAAPAVQAADFKRMVKGWVQADSYLSFYSDAPVSSIVRAKAIAADPLILPADPLIGYKQYAGMDRAVQHRPDYSAGLAMYSSRTNSFEAINSENGKAWYTSAGMLSLYNNDLGQYSEDFWPTVDSYRLPGTTVLSQTPSASHKSANAWTGGTDMLGQYGVSGMDLQDANHTLGARKSWFMFDDEMVALGAGITSTDSIAAETIVENRKLSGAGNETLTVNGTVQPASLGWSSTLSSVEWAHLAGSAPGSDIGYYFPGGTSLEAKREARTGNWKQINTRPVTPATPITRSYMTMWLNHGTNPTDAAYEYVLLPNKSSAEVAAYAADSHVQVLANSAEVQAVREKTLNLIGANFWTDSLQSVDFITVNKKATVMTKESAEGSLDLSISDPTQLGTGYIEVELDRTAESFTADAGISVTQLSPTIKLRVNTNLARGKSFKASFQLGEDVPPVTYEDVIVDNNDTAFVAKTGTWKTASTQTDRYGSNYLHDDNAGKGTKSITFTPDLPVSGTYRVYMMWPQHANRSIAVPLSIGHAAGTASLTVNQTANGGIWNLLGTFTFDEGEHGAITLGNEGTSGYVTADAVRFEYVAPGS

SEQ ID NO: 111 - DNA, 2805 bp, Artificial Sequence
  Synthetic construct
  CDS (1)..(2802)
  sig_peptide (1)..(81)
  mat_peptide (82)..(2802)
atgaagaaaccgttggggaaaattgtcgcaagcaccgcactactcatttctgttgcttttagttcatcgatagcatcagcacatcatcatcaccatcatcctaggtcagatgaatatgatacgatgcgggaaaaccgcaaggcgatgcttaccggaggggcaggcttgaatatggctgatgcagatattgcggcagcggtagcggcactggcggcagaggcagacggttactggcaatcaatgaataaggctgcgggacgaacagctctatggagcgatcagcaaggcgtcggcaactccattcatattcgcatcagctatgaacggctgaaccggatggcgctggcgtacgcgaccgaaggctcagcgctttatggtcatacggcgcttgccgacgatctggtcagtgcgctggatttcatgtatgccactaggtatcatgagcttgtcactacgactccgagcgggacaagcaattggtgggactggcagatcggcattccgatgcagcttaatgatgcggttgtgcttatgtacgacgacttaagcacgacacagatccatcattatatgaaagcggtggaacgcttcacgcccgtcgtcaatctgactggtgcgaatcgttcctggaaagcgatggtcgtggcgatcagaggaatcattgttaaggacggagtcaaaatcgccgctgcccgtgatgggctgtcgcaaatctttccttatgtggtgagcggagacggcttctatcgcgatggctctttcatccagcatagtacgattccgtatacaggcggctatgggcttgatctactgctggctgtaagcgatctgttggctgtgctgcacggatcgacctggcaggtgaccgatccgaaccacgcgaatgtgtgggactgggtgtatcaagcgtatcagccgctcatctacaagggagccatcatggatatggtgcgcggccgggagatatccaggcactacaggcaggatcacgctgcaggccatgtagctattcagggcatcctgctgctgtcggaggcggctccggctgtacaagcggcagactttaaacggatggtcaaaggctgggtgcaggcggatagctatttgtccttctattcggatgcgccggtctcttccatcgtcagggccaaggccattgcagccgatccgctcattttgccagccgatccgcttatcgggtataagcaatatgccggcatggacagagcggtacagcaccggccggattacagcgcaggattagccatgtattcaagccgcacaaacagctttgaagcgatcaacagcgagaacggcaaggcctggtatacctcagcaggaatgcttagcttgtataataacgatttgggacaatacagcgaggacttctggccaacggtcgactcttatcgcttgcctggcacgacggtcctgtcgcaaacgccgtctgcgagtcacaaaagcgctaatgcctggacgggaggaaccgatatgctaggtcagtacggcgtttccggtatggaccttcaggatgccaaccacacgcttggcgcccgtaaatcctggtttatgttcgatgacgaaatggttgctctcggtgcgggaatcaccagcacggacagcatagcggctgaaaccattgtggagaaccgaaagctgagcggcgcaggcaatgagacactgaccgttaacggcactgtacagccagcatcgctcggctggtcgtcgacattgagcagcgtggagtgggcacatttggcaggctccgctccgggctccgatattggctattacttccccggtgggacgagccttgaagcgaagcgggaagcgagaaccggcaattggaaacagattaacacgcgtccggtaacgcctgcgactccaatcacacgctcctacatgacgatgtggctgaaccacggcacaaatccgacggatgcggcctatgaatatgtactgctgccgaacaaatcgagcgccgaggtagctgcatatgctgcagattcgcatgttcaggtgctggcaaattcagccgaggtgcaggcggtgagagagaagacgcttaacttgatcggcgcgaacttctggaccgacagcctgcaaagcgtggattttatcacagtgaacaaaaaggcaaccgtgatgacgaaggagtcggcagagggtagtctcgacctgtcgatcagcgatccgacccagcttggtacgggctatatcgaggttgagcttgaccgtactgccgagagctttaccgctgatgccgggatttcggtgacgcagctaagtccgacgatcaagctaagggtcaataccaatctggcgcgtggcaaaagctttaaggcgtccttccagctaggggaggacgtgccgcctgttacctatgaagatgtgattgtcgataacaatgatacggcgtttgttgccaagacgggaacatggaagacggcatcaacgcaaacggatcgttatggaagtaattacctgcatgacgataatgctggcaaggggaccaaaagcattacgtttaccccggatttgccagtgtcgggaacgtacagggtatacatgatgtggccgcagcatgccaaccgctcgatcgctgtgcccttatccataggacatgcggcaggtacagcatcattaacggttaatcagacggcaaacgggggaatatggaatctgcttggcaccttcacgtttgacgaaggagagcatggagccatcacgctaggcaatgagggcacaagcggctatgtgactgccgatgctgtgaggtttgaatatgtggcgccaggctcttag

SEQ ID NO: 112 - protein, 934 aa, Artificial Sequence
  Synthetic Construct
MKKPLGKIVASTALLISVAFSSSIASAHHHHHHPRSDEYDTMRENRKAMLTGGAGLNMADADIAAAVAALAAEADGYWQSMNKAAGRTALWSDQQGVGNSIHIRISYERLNRMALAYATEGSALYGHTALADDLVSALDFMYATRYHELVTTTPSGTSNWWDWQIGIPMQLNDAVVLMYDDLSTTQIHHYMKAVERFTPVVNLTGANRSWKAMVVAIRGIIVKDGVKIAAARDGLSQIFPYVVSGDGFYRDGSFIQHSTIPYTGGYGLDLLLAVSDLLAVLHGSTWQVTDPNHANVWDWVYQAYQPLIYKGAIMDMVRGREISRHYRQDHAAGHVAIQGILLLSEAAPAVQAADFKRMVKGWVQADSYLSFYSDAPVSSIVRAKAIAADPLILPADPLIGYKQYAGMDRAVQHRPDYSAGLAMYSSRTNSFEAINSENGKAWYTSAGMLSLYNNDLGQYSEDFWPTVDSYRLPGTTVLSQTPSASHKSANAWTGGTDMLGQYGVSGMDLQDANHTLGARKSWFMFDDEMVALGAGITSTDSIAAETIVENRKLSGAGNETLTVNGTVQPASLGWSSTLSSVEWAHLAGSAPGSDIGYYFPGGTSLEAKREARTGNWKQINTRPVTPATPITRSYMTMWLNHGTNPTDAAYEYVLLPNKSSAEVAAYAADSHVQVLANSAEVQAVREKTLNLIGANFWTDSLQSVDFITVNKKATVMTKESAEGSLDLSISDPTQLGTGYIEVELDRTAESFTADAGISVTQLSPTIKLRVNTNLARGKSFKASFQLGEDVPPVTYEDVIVDNNDTAFVAKTGTWKTASTQTDRYGSNYLHDDNAGKGTKSITFTPDLPVSGTYRVYMMWPQHANRSIAVPLSIGHAAGTASLTVNQTANGGIWNLLGTFTFDEGEHGAITLGNEGTSGYVTADAVRFEYVAPGS

SEQ ID NO: 113 - DNA, 2877 bp, Paenibacillus sp
  CDS (1)..(2874)
  sig_peptide (1)..(183)
  mat_peptide (184)..(2874)
atgataaaggggggatccaccgccaacgtgcgctttgtatcaactaattgtaagcgcttcaaattaaagttgaagggtgatgagcagatgaaacgaaacgggagccggacggtcaagtggctgctggcgttggtgctattgtggggaatctggggggcgggaccgccgccgcaggcgtcagcgtccgacgcgtatgatgcaatgcgagaaaaacgcaagacgatgctgacgggtggcacggcactctcctggacggatcccgatcttgcggctgcagccgagagaatcacggatcaggcggagcattattggtcaacgatgaatctctcaccaacccggacacatctctggagtgatcaggcgggcatgggcaactcgatccatatccgcatcacctatgagcgcctcaaggcgctggcgctggcctatacgactgaaggctctgatctatacggcgatgcctcgctggcagcggaccttatcggtgcgctggattatatgtacgctacccgctatcacgagcatgtgacgacaacgccgagcggcacgagtaactggtgggattggcagatcggcatccctatgcagttgggtgacatcgtcgtcctcctgtatgatcagctcacccccgctcaagtaaccaactatatgaacgccgtggagcgcttcacgcctcttgtcaatctaaccggcgccaaccgctcctggaaagctattgtggtcgccgtacgcggcattctcgtcaaggattcggccaaaatcattatggcccgcgacggactgtcggccatcttcccctatgcggtaagcggcgacggcttctatcgcgatggttctttcatccagcatgccacggttccctacaatggggggtacggtctggatctgctgctcgcggtgggagatctgatggccctgctccatgattcgccgtggcagataaccgacccgagcagcgccaacgtatggagttgggtatacgatgcttatgaaccgcttatctataagggtgccatgatggatatggtaaggggacgcgagatctcgcgggtataccgccaggaccatgccgcaggccatgtcgcgatccagggcatcctccggctatccgagattgcgcccgcgccgcaggcctcagacttccggcggatggtcaagggctggctgcaggcggacgaattcctcagcttctacgattcggcgccggtacagctcattgcggcggccaagtcactgctgacggattcggcggttgagcctcgggatgcgctgattctatacaagccgtacccggcaatggaccgggcggtgcagcatcgcccgggctatgcgatcggcctggcgatgtactccagccggatcagcagcttcgaagcaatcaacagcgagaatgccaaggcgtggtatacatccgcagggatgaccagtctgtacaatagcgacctcgggcactacagcgaagactattggccaacggtagacccctatcggctgccggggacaacggtgttgactcagacgccgacgcctacacatcgcagcggcagtccctggaccggtggaaccgtactggacggccaatacggtgtagccgggatggagctggattataccggtcacgcgctcagcggccgcaagtcgtggttcctgttcgacgacgagatggtggcgctcggcagtgggattgccagcacagacggaatcggtgtcgagacgatcgtcgagaatcgcaagctggacgctaccgggcagaacgcgcttaccgtgaatggcatcctgaagccgcagctgccgggctggacagagacgttgtcgagcgtatcctggatgcatctggcgggtagcagcggaccggatgcagacatcggctattattttcccgaagcgcctgacgtgaaggcggtccgcgaggcgcgagtaggcaactggcggcagatcaatattcggccggtgacgccaacgacgccgatcacccggaactatcaaaccctgtggctggaccacggcgtggatcctgtggatgatgggtatcaatatgtcctgctgcccggccgctcggcagccgaagtagccggctatgcggccgcacctgagatcgacattctggagaatacgcaggctattcaggcggtcagggagaacgggcttggcgtgacggcggtgaacttttggacggatcagtgggagagtgcaggcggcatatctgccaatcgccgggcttccgtcatgactcgcgagggcagtgatggcgggttaaccgttgccgtcagcgacccgacccaattgaacaacagcaccatcgagctggagctggactactcggctagcagcttcatcgccgaaccagggatcaccgttactcaactcagtccgacggtcaagctaactgtcttagtggccaatgccaagggcaagacattcacggcctcctttgagccgggagaggctcccccggtaacgccgcccgttagtatcatcgtagacaatgcggatgcttccggtgtaacccggatcggagcgtggaagacggccagcacgcagagtgaccgttatggccccaattacctgcatgatgacaatcgcgacaagggcaccaaatcggttgtctatacgccagagattctgaccagcggggattacaaggtctatatgatgtggcctgcccactttaatcggtcgacggcgatccccgtagacattgtttatagcggcggaacgagcagtgcaagcgtggatcagacgcagaacggaggggtatgggtagagctgggcacctatcctttggatgccggaacctcaggcagcgttacgatcagtaataccggtacgacgggctttgtggtagcggatgcggtcaagtttgagttgatccagtag

SEQ ID NO: 114 - protein, 958 aa, Paenibacillus sp
MIKGGSTANVRFVSTNCKRFKLKLKGDEQMKRNGSRTVKWLLALVLLWGIWGAGPPPQASASDAYDAMREKRKTMLTGGTALSWTDPDLAAAAERITDQAEHYWSTMNLSPTRTHLWSDQAGMGNSIHIRITYERLKALALAYTTEGSDLYGDASLAADLIGALDYMYATRYHEHVTTTPSGTSNWWDWQIGIPMQLGDIVVLLYDQLTPAQVTNYMNAVERFTPLVNLTGANRSWKAIVVAVRGILVKDSAKIIMARDGLSAIFPYAVSGDGFYRDGSFIQHATVPYNGGYGLDLLLAVGDLMALLHDSPWQITDPSSANVWSWVYDAYEPLIYKGAMMDMVRGREISRVYRQDHAAGHVAIQGILRLSEIAPAPQASDFRRMVKGWLQADEFLSFYDSAPVQLIAAAKSLLTDSAVEPRDALILYKPYPAMDRAVQHRPGYAIGLAMYSSRISSFEAINSENAKAWYTSAGMTSLYNSDLGHYSEDYWPTVDPYRLPGTTVLTQTPTPTHRSGSPWTGGTVLDGQYGVAGMELDYTGHALSGRKSWFLFDDEMVALGSGIASTDGIGVETIVENRKLDATGQNALTVNGILKPQLPGWTETLSSVSWMHLAGSSGPDADIGYYFPEAPDVKAVREARVGNWRQINIRPVTPTTPITRNYQTLWLDHGVDPVDDGYQYVLLPGRSAAEVAGYAAAPEIDILENTQAIQAVRENGLGVTAVNFWTDQWESAGGISANRRASVMTREGSDGGLTVAVSDPTQLNNSTIELELDYSASSFIAEPGITVTQLSPTVKLTVLVANAKGKTFTASFEPGEAPPVTPPVSIIVDNADASGVTRIGAWKTASTQSDRYGPNYLHDDNRDKGTKSVVYTPEILTSGDYKVYMMWPAHFNRSTAIPVDIVYSGGTSSASVDQTQNGGVWVELGTYPLDAGTSGSVTISNTGTTGFVVADAVKFELIQ

SEQ ID NO: 115 - DNA, 2799 bp, Artificial Sequence
  Synthetic construct
  CDS (1)..(2796)
  sig_peptide (1)..(81)
  mat_peptide (82)..(2796)
atgaagaaaccgttggggaaaattgtcgcaagcaccgcactactcatttctgttgcttttagttcatcgatagcatcagcacatcatcatcaccatcatcctaggtccgacgcgtatgatgcaatgcgagaaaaacgcaagacgatgctgacgggtggcacggcactctcctggacggatcccgatcttgcggctgcagccgagagaatcacggatcaggcggagcattattggtcaacgatgaatctctcaccaacccggacacatctctggagtgatcaggcgggcatgggcaactcgatccatatccgcatcacctatgagcgcctcaaggcgctggcgctggcctatacgactgaaggctctgatctatacggcgatgcctcgctggcagcggaccttatcggtgcgctggattatatgtacgctacccgctatcacgagcatgtgacgacaacgccgagcggcacgagtaactggtgggattggcagatcggcatccctatgcagttgggtgacatcgtcgtcctcctgtatgatcagctcacccccgctcaagtaaccaactatatgaacgccgtggagcgcttcacgcctcttgtcaatctaaccggcgccaaccgctcctggaaagctattgtggtcgccgtacgcggcattctcgtcaaggattcggccaaaatcattatggcccgcgacggactgtcggccatcttcccctatgcggtaagcggcgacggcttctatcgcgatggttctttcatccagcatgccacggttccctacaatggggggtacggtctggatctgctgctcgcggtgggagatctgatggccctgctccatgattcgccgtggcagataaccgacccgagcagcgccaacgtatggagttgggtatacgatgcttatgaaccgcttatctataagggtgccatgatggatatggtaaggggacgcgagatctcgcgggtataccgccaggaccatgccgcaggccatgtcgcgatccagggcatcctccggctatccgagattgcgcccgcgccgcaggcctcagacttccggcggatggtcaagggctggctgcaggcggacgaattcctcagcttctacgattcggcgccggtacagctcattgcggcggccaagtcactgctgacggattcggcggttgagcctcgggatgcgctgattctatacaagccgtacccggcaatggaccgggcggtgcagcatcgcccgggctatgcgatcggcctggcgatgtactccagccggatcagcagcttcgaagcaatcaacagcgagaatgccaaggcgtggtatacatccgcagggatgaccagtctgtacaatagcgacctcgggcactacagcgaagactattggccaacggtagacccctatcggctgccggggacaacggtgttgactcagacgccgacgcctacacatcgcagcggcagtccctggaccggtggaaccgtactggacggccaatacggtgtagccgggatggagctggattataccggtcacgcgctcagcggccgcaagtcgtggttcctgttcgacgacgagatggtggcgctcggcagtgggattgccagcacagacggaatcggtgtcgagacgatcgtcgagaatcgcaagctggacgctaccgggcagaacgcgcttaccgtgaatggcatcctgaagccgcagctgccgggctggacagagacgttgtcgagcgtatcctggatgcatctggcgggtagcagcggaccggatgcagacatcggctattattttcccgaagcgcctgacgtgaaggcggtccgcgaggcgcgagtaggcaactggcggcagatcaatattcggccggtgacgccaacgacgccgatcacccggaactatcaaaccctgtggctggaccacggcgtggatcctgtggatgatgggtatcaatatgtcctgctgcccggccgctcggcagccgaagtagccggctatgcggccgcacctgagatcgacattctggagaatacgcaggctattcaggcggtcagggagaacgggcttggcgtgacggcggtgaacttttggacggatcagtgggagagtgcaggcggcatatctgccaatcgccgggcttccgtcatgactcgcgagggcagtgatggcgggttaaccgttgccgtcagcgacccgacccaattgaacaacagcaccatcgagctggagctggactactcggctagcagcttcatcgccgaaccagggatcaccgttactcaactcagtccgacggtcaagctaactgtcttagtggccaatgccaagggcaagacattcacggcctcctttgagccgggagaggctcccccggtaacgccgcccgttagtatcatcgtagacaatgcggatgcttccggtgtaacccggatcggagcgtggaagacggccagcacgcagagtgaccgttatggccccaattacctgcatgatgacaatcgcgacaagggcaccaaatcggttgtctatacgccagagattctgaccagcggggattacaaggtctatatgatgtggcctgcccactttaatcggtcgacggcgatccccgtagacattgtttatagcggcggaacgagcagtgcaagcgtggatcagacgcagaacggaggggtatgggtagagctgggcacctatcctttggatgccggaacctcaggcagcgttacgatcagtaataccggtacgacgggctttgtggtagcggatgcggtcaagtttgagttgatccagtag

SEQ ID NO: 116 - protein, 932 aa, Artificial Sequence
  Synthetic Construct
MKKPLGKIVASTALLISVAFSSSIASAHHHHHHPRSDAYDAMREKRKTMLTGGTALSWTDPDLAAAAERITDQAEHYWSTMNLSPTRTHLWSDQAGMGNSIHIRITYERLKALALAYTTEGSDLYGDASLAADLIGALDYMYATRYHEHVTTTPSGTSNWWDWQIGIPMQLGDIVVLLYDQLTPAQVTNYMNAVERFTPLVNLTGANRSWKAIVVAVRGILVKDSAKIIMARDGLSAIFPYAVSGDGFYRDGSFIQHATVPYNGGYGLDLLLAVGDLMALLHDSPWQITDPSSANVWSWVYDAYEPLIYKGAMMDMVRGREISRVYRQDHAAGHVAIQGILRLSEIAPAPQASDFRRMVKGWLQADEFLSFYDSAPVQLIAAAKSLLTDSAVEPRDALILYKPYPAMDRAVQHRPGYAIGLAMYSSRISSFEAINSENAKAWYTSAGMTSLYNSDLGHYSEDYWPTVDPYRLPGTTVLTQTPTPTHRSGSPWTGGTVLDGQYGVAGMELDYTGHALSGRKSWFLFDDEMVALGSGIASTDGIGVETIVENRKLDATGQNALTVNGILKPQLPGWTETLSSVSWMHLAGSSGPDADIGYYFPEAPDVKAVREARVGNWRQINIRPVTPTTPITRNYQTLWLDHGVDPVDDGYQYVLLPGRSAAEVAGYAAAPEIDILENTQAIQAVRENGLGVTAVNFWTDQWESAGGISANRRASVMTREGSDGGLTVAVSDPTQLNNSTIELELDYSASSFIAEPGITVTQLSPTVKLTVLVANAKGKTFTASFEPGEAPPVTPPVSIIVDNADASGVTRIGAWKTASTQSDRYGPNYLHDDNRDKGTKSVVYTPEILTSGDYKVYMMWPAHFNRSTAIPVDIVYSGGTSSASVDQTQNGGVWVELGTYPLDAGTSGSVTISNTGTTGFVVADAVKFELIQ

SEQ ID NO: 117 - DNA, 2883 bp, Paenibacillus sp
  CDS (1)..(2880)
  sig_peptide (1)..(81)
  mat_peptide (82)..(2880)
atgagaagagggcgatggtttaagagcggtgtgatcggtctggccgccatgctgatctttgcggcggcgggcagtatggcgggcggcgaagcgagcgggagtgcggacgatgcggcggaaacggcagaagcggcggaaggagagaatattgaggataaaatggtaagcgcttacaatatggatgcgttcgatataatgcgcgaggtgcggagaacgatgctgaccggcggggccgccctaaatccggcggatccggacgccgcggcggccgtcgcggccttggcgtccgaggccaatcaatactggcagacgatggacgactcgccggggcggacgagcctgtggagcgataatcccggcaccggcaactccattcatatccggattacctacgaacggctcaagacgatggcgctcgcttacgccgcggccggttcgccgctgcatagcaacgcttcgctcgaagcggatatcgtcgacgcgctggattatatgtacgcgacccgctaccacgagaacgtaacgacgacgccgagcggcacgagcaattggtgggattggcagatcggcattccgatgcagctgaacgatacggtcgtgttaatgtacgattcgttaactccggctcaaattgccaattatatgaacgctgtggagcgctttacgccgacggtcaatctgaccggagccaaccgctcctggaaagcgattgtcgtcgccgtgcgcggcattctggtcaaagacggcgcgaaaatcgccgccgcccgcgacgggctgtcgcaaattttcaattatgccgtcagcggcgacggattttaccgtgacgggtcgttcatccagcacggcaatatcccttataacggcggctacgggctggatctgctgctggccgtcagcgatttgatgacgctgctgcacgggtcggcctggcaggtgaccgatccgaatcaggcgaacgtatgggaatgggtttaccgggcttatcagccgctcatctataaaggcgcgatgatggacatggtgcgcggacgggaaatttcccgggtttaccggcaggatcatgcggccggacatatcgcgatgcagggcattttgcggctgtcggcggtcgctccgccggcgcaggcggaagatttcaaacggatggtcaaaggctggatggttgtggacggatttatgcgtttttacgagcaagcgccgctcggccttatcccgctcgccaaagccgttgaaggggacgcatcgatcgcgccggcgagcgagttgattcaataccggcagtatgcggcaatggacagagcggtgcagcttcgtcccggctacggcttcggtctggcgatgtattcgagccggatcggcagctttgaagcgatcaacagcgaaaacttgagaggctggtacacttcggccggcatgaccagcttgtataacggcgacctcgggcattacagcgaagattactggccgacggtcaacgcctaccggctgccgggaacgaccgtattgtccggcacggccgcggccagccacaccagcccgaacaactggacgggaggcaccgacatgcaggggctgtacggcgtatccggcatggacttaaagtatgcctccaactcgctggcggcgcggaaatcgtggtttatgttcgatgacgagatcgtcgcgctgggcgccgggatttcgagcgcggacggcatcccggtcgaaacgatcatcgagaaccgccggatcggcggcgccggggacaacgcttttctggcggacggcgcggcgatgccggccgagcttggatggtccgggacgctggagggagtccgctgggcgcatttgaccggtaccgcggccggcgcggacatcggttattattttcccgagcctgcggctgtccatgcggtgcgggaggcgcggacgggcaactggcggcagatcaataaccgcccggtgacgcctgcggcttccgtgacgcgcaattatttgacgttctggttcgatcatggggcgaatccgaccaatgccgactatcaatatgtactgctgccgaacaagtcgggcgctcaagttgcgggttatgcggccaatcccgatgtcgaggtgctggccaactcgccggaggtgcaggcggtgaaggaatcatcgcttggcatcatcggcgcgaatttctggtcggacggcgtgcggacagtggacctcattaccgtgaacaagaaagcgtcggtcatgacgcgggagacgcccggcgcaatcctcgacctatccgtcagcgatccgacccaggtgaacgcaggcacgatcgagatcgagctgaaccgcgcggcgagcggctttaccgccgatcccggcgttacggtgacgcggctcagcccgacgatcaagctgacggttcaggtggccggagccaaaggcaggtcgttcaaggcttcgttcgagttgggcgaagcgtcggggccagggccagatccggggccggggccgtccgagattatcgtggacaacggcgatgccgccggcgtgacgaagatcggcagttggaagacgggaacggtccagacggaccgatatggcccggattatctgcatgacgacaacaccggcaaaggcggcaaaagcgtaaggttcacgccggacctgccgacggctggcacgtacgacgtctacatgatgtggccgcagcatttcaaccgggcgacgaacattccggtgacgatcgcccatgcgggcggtacggccacggtgacgatcgatcagacggtaagcggcggcgtctggaactatttgggcagctacagctttgacaccggcagtggcggcagcgtgacgatcagtaacgccggtaccaacggttacgtggtcgcagacgcggtcaaatttgaatatgtgccgtaa

SEQ ID NO: 118 - protein, 960 aa, Paenibacillus sp
MRRGRWFKSGVIGLAAMLIFAAAGSMAGGEASGSADDAAETAEAAEGENIEDKMVSAYNMDAFDIMREVRRTMLTGGAALNPADPDAAAAVAALASEANQYWQTMDDSPGRTSLWSDNPGTGNSIHIRITYERLKTMALAYAAAGSPLHSNASLEADIVDALDYMYATRYHENVTTTPSGTSNWWDWQIGIPMQLNDTVVLMYDSLTPAQIANYMNAVERFTPTVNLTGANRSWKAIVVAVRGILVKDGAKIAAARDGLSQIFNYAVSGDGFYRDGSFIQHGNIPYNGGYGLDLLLAVSDLMTLLHGSAWQVTDPNQANVWEWVYRAYQPLIYKGAMMDMVRGREISRVYRQDHAAGHIAMQGILRLSAVAPPAQAEDFKRMVKGWMVVDGFMRFYEQAPLGLIPLAKAVEGDASIAPASELIQYRQYAAMDRAVQLRPGYGFGLAMYSSRIGSFEAINSENLRGWYTSAGMTSLYNGDLGHYSEDYWPTVNAYRLPGTTVLSGTAAASHTSPNNWTGGTDMQGLYGVSGMDLKYASNSLAARKSWFMFDDEIVALGAGISSADGIPVETIIENRRIGGAGDNAFLADGAAMPAELGWSGTLEGVRWAHLTGTAAGADIGYYFPEPAAVHAVREARTGNWRQINNRPVTPAASVTRNYLTFWFDHGANPTNADYQYVLLPNKSGAQVAGYAANPDVEVLANSPEVQAVKESSLGIIGANFWSDGVRTVDLITVNKKASVMTRETPGAILDLSVSDPTQVNAGTIEIELNRAASGFTADPGVTVTRLSPTIKLTVQVAGAKGRSFKASFELGEASGPGPDPGPGPSEIIVDNGDAAGVTKIGSWKTGTVQTDRYGPDYLHDDNTGKGGKSVRFTPDLPTAGTYDVYMMWPQHFNRATNIPVTIAHAGGTATVTIDQTVSGGVWNYLGSYSFDTGSGGSVTISNAGTNGYVVADAVKFEYVP

SEQ ID NO: 119 - DNA, 2907 bp, Artificial Sequence
  Synthetic construct
  CDS (1)..(2904)
  sig_peptide (1)..(81)
  mat_peptide (82)..(2904)
atgaagaaaccgttggggaaaattgtcgcaagcaccgcactactcatttctgttgcttttagttcatcgatagcatcagcacatcatcatcaccatcatcctaggggcggcgaagcgagcgggagtgcggacgatgcggcggaaacggcagaagcggcggaaggagagaatattgaggataaaatggtaagcgcttacaatatggatgcgttcgatataatgcgcgaggtgcggagaacgatgctgaccggcggggccgccctaaatccggcggatccggacgccgcggcggccgtcgcggccttggcgtccgaggccaatcaatactggcagacgatggacgactcgccggggcggacgagcctgtggagcgataatcccggcaccggcaactccattcatatccggattacctacgaacggctcaagacgatggcgctcgcttacgccgcggccggttcgccgctgcatagcaacgcttcgctcgaagcggatatcgtcgacgcgctggattatatgtacgcgacccgctaccacgagaacgtaacgacgacgccgagcggcacgagcaattggtgggattggcagatcggcattccgatgcagctgaacgatacggtcgtgttaatgtacgattcgttaactccggctcaaattgccaattatatgaacgctgtggagcgctttacgccgacggtcaatctgaccggagccaaccgctcctggaaagcgattgtcgtcgccgtgcgcggcattctggtcaaagacggcgcgaaaatcgccgccgcccgcgacgggctgtcgcaaattttcaattatgccgtcagcggcgacggattttaccgtgacgggtcgttcatccagcacggcaatatcccttataacggcggctacgggctggatctgctgctggccgtcagcgatttgatgacgctgctgcacgggtcggcctggcaggtgaccgatccgaatcaggcgaacgtatgggaatgggtttaccgggcttatcagccgctcatctataaaggcgcgatgatggacatggtgcgcggacgggaaatttcccgggtttaccggcaggatcatgcggccggacatatcgcgatgcagggcattttgcggctgtcggcggtcgctccgccggcgcaggcggaagatttcaaacggatggtcaaaggctggatggttgtggacggatttatgcgtttttacgagcaagcgccgctcggccttatcccgctcgccaaagccgttgaaggggacgcatcgatcgcgccggcgagcgagttgattcaataccggcagtatgcggcaatggacagagcggtgcagcttcgtcccggctacggcttcggtctggcgatgtattcgagccggatcggcagctttgaagcgatcaacagcgaaaacttgagaggctggtacacttcggccggcatgaccagcttgtataacggcgacctcgggcattacagcgaagattactggccgacggtcaacgcctaccggctgccgggaacgaccgtattgtccggcacggccgcggccagccacaccagcccgaacaactggacgggaggcaccgacatgcaggggctgtacggcgtatccggcatggacttaaagtatgcctccaactcgctggcggcgcggaaatcgtggtttatgttcgatgacgagatcgtcgcgctgggcgccgggatttcgagcgcggacggcatcccggtcgaaacgatcatcgagaaccgccggatcggcggcgccggggacaacgcttttctggcggacggcgcggcgatgccggccgagcttggatggtccgggacgctggagggagtccgctgggcgcatttgaccggtaccgcggccggcgcggacatcggttattattttcccgagcctgcggctgtccatgcggtgcgggaggcgcggacgggcaactggcggcagatcaataaccgcccggtgacgcctgcggcttccgtgacgcgcaattatttgacgttctggttcgatcatggggcgaatccgaccaatgccgactatcaatatgtactgctgccgaacaagtcgggcgctcaagttgcgggttatgcggccaatcccgatgtcgaggtgctggccaactcgccggaggtgcaggcggtgaaggaatcatcgcttggcatcatcggcgcgaatttctggtcggacggcgtgcggacagtggacctcattaccgtgaacaagaaagcgtcggtcatgacgcgggagacgcccggcgcaatcctcgacctatccgtcagcgatccgacccaggtgaacgcaggcacgatcgagatcgagctgaaccgcgcggcgagcggctttaccgccgatcccggcgttacggtgacgcggctcagcccgacgatcaagctgacggttcaggtggccggagccaaaggcaggtcgttcaaggcttcgttcgagttgggcgaagcgtcggggccagggccagatccggggccggggccgtccgagattatcgtggacaacggcgatgccgccggcgtgacgaagatcggcagttggaagacgggaacggtccagacggaccgatatggcccggattatctgcatgacgacaacaccggcaaaggcggcaaaagcgtaaggttcacgccggacctgccgacggctggcacgtacgacgtctacatgatgtggccgcagcatttcaaccgggcgacgaacattccggtgacgatcgcccatgcgggcggtacggccacggtgacgatcgatcagacggtaagcggcggcgtctggaactatttgggcagctacagctttgacaccggcagtggcggcagcgtgacgatcagtaacgccggtaccaacggttacgtggtcgcagacgcggtcaaatttgaatatgtgccgtaa

SEQ ID NO: 120 - protein, 968 aa, Artificial Sequence
  Synthetic Construct
MKKPLGKIVASTALLISVAFSSSIASAHHHHHHPRGGEASGSADDAAETAEAAEGENIEDKMVSAYNMDAFDIMREVRRTMLTGGAALNPADPDAAAAVAALASEANQYWQTMDDSPGRTSLWSDNPGTGNSIHIRITYERLKTMALAYAAAGSPLHSNASLEADIVDALDYMYATRYHENVTTTPSGTSNWWDWQIGIPMQLNDTVVLMYDSLTPAQIANYMNAVERFTPTVNLTGANRSWKAIVVAVRGILVKDGAKIAAARDGLSQIFNYAVSGDGFYRDGSFIQHGNIPYNGGYGLDLLLAVSDLMTLLHGSAWQVTDPNQANVWEWVYRAYQPLIYKGAMMDMVRGREISRVYRQDHAAGHIAMQGILRLSAVAPPAQAEDFKRMVKGWMVVDGFMRFYEQAPLGLIPLAKAVEGDASIAPASELIQYRQYAAMDRAVQLRPGYGFGLAMYSSRIGSFEAINSENLRGWYTSAGMTSLYNGDLGHYSEDYWPTVNAYRLPGTTVLSGTAAASHTSPNNWTGGTDMQGLYGVSGMDLKYASNSLAARKSWFMFDDEIVALGAGISSADGIPVETIIENRRIGGAGDNAFLADGAAMPAELGWSGTLEGVRWAHLTGTAAGADIGYYFPEPAAVHAVREARTGNWRQINNRPVTPAASVTRNYLTFWFDHGANPTNADYQYVLLPNKSGAQVAGYAANPDVEVLANSPEVQAVKESSLGIIGANFWSDGVRTVDLITVNKKASVMTRETPGAILDLSVSDPTQVNAGTIEIELNRAASGFTADPGVTVTRLSPTIKLTVQVAGAKGRSFKASFELGEASGPGPDPGPGPSEIIVDNGDAAGVTKIGSWKTGTVQTDRYGPDYLHDDNTGKGGKSVRFTPDLPTAGTYDVYMMWPQHFNRATNIPVTIAHAGGTATVTIDQTVSGGVWNYLGSYSFDTGSGGSVTISNAGTNGYVVADAVKFEYVP

SEQ ID NO: 121 - DNA, 3276 bp, Paenibacillus sp
  CDS (1)..(3273)
  sig_peptide (1)..(126)
  mat_peptide (127)..(3273)
atgaacaattcaaaaatcagcaccgcgagcaagttgaggaaaaggtcttccattgcgatttgcgtcatgatgtcttatgtgatggctttaagtttaatgatcgttaatccatccccggtagcagccgcggacgaatacgacacgattagggagaaatataaggaaacgttaacaggaagcgcgtcctacaacacgtctgatcccgatattgccgcaagaattacgggaataaccaataaagcctatgaagtatgggactccatgatcaaaacacctggtcgggcgcagctgtgggcggaatatgggcttggtgcacccaatacggggagtagtggggataatctaacgcccatttacgcgaatctcaaacatatggctcttgcctattcgacgagaggctcgagcttagaaggaaatacaacgttaagagatgatattattagcggtttagattggatgaatacgaacaaattcttttacggggctacgtattcggggaactggtggcatagggaaataggggctccgcaacagcttcttgcggtaacggttctcatgtatgacgatctgacgccgacgcaaattgccaattacatggctgccattcaatggatggctgatgtcatagatggatcaggcgctaatcgggcttggcaatccgagatcgttgcgcttagagggatcgtgattaaagatagcgttacaatcgcgagaggtacggcagggctaagcaacatatttgactacgttaaaagcagagacggcttctacgaggatggctccttcgtacagcataacttctacgcctatacgggtggctacggggcatccctcctcaaagcaatgagcaatctcatctatctcgtcggagggtcttcgttcgatattacggatcccgacaaagcgaatgtctatcggtgggtctatgattcctatgagccgctgatctataaaggcgccatgatggatatggtcagaggcagagagatctcgagacactacgaggaggactatgtgtcagcccaagatgtcattcgcgcgatcctgctattgtccgaagtcgcttccccaacagatggattagcatacaagcgcatggtgaaggattggatgatgcagggagacaggttaacggatctattatcgacttcatcgctcttcatgttcgaggagatgacagcattgatgaacaatacggccatcgcgccaagaggcgaattgctgaagtacaaacagttccccggcatggatcgcgcggtgcagcttagacctgggtacgggttcggcatcagcatgcactctactcgtattgcggcgtttgaatccattaatagcgagaacggcaaaggatggcataccggagatggcatgacttatctatataacaacgatctgtcgcagtatagcgataattactggcctacggtcaattcctacagacttcctggaacgacggttctgcagccgtccactctaacgcccgagaaagtatcggataagaattgggtcggaggaacggatatgtccgggatatacggggtgacggggatggagctgcatccatacggtcagacccttacggccaagaagtcctggttcatgttcgacgacgagatcgtggctttgggctcggggatcacgagcaccgataacattgccgtagagacgatcgcggagaatcggaagatcaatagcagcggagacaatgcgctgaccgtgaacggcacggccaagccgacgacgctcggctggacggagaatatgacgggcgttaactccattcatctggcaggcaacgtagcgggctcggatatcggctactacttccctggatccgcgaatgttgcgggattgcgtgaagctagaaccgggaactgggatcagataggagttgggcctaatacgaaccatacgcgcaattacttgagcttgggcttgaaccatggcgtcaacccgacgaatgcgacctatgcctacgtgacgctgccgaacaagacgagttcgcaggtaagcgcctatgcgagcaatccgaatattacgatcctggagaattcgaccgatgctcaggccgtgaaggagaatggcatgaacatggtgggcatcaacttctggaacgatgtcgtcaagacggtcggcctcgtgacgtcgaaccgcaagtcttccgtcatgacgaaggagacggcgagcgacttcgaggtgtccgtatcggatccgaccaaagcgggcagagacacggtcgacattgagatcaacaagagcgcgacgagcatcatctccgtcgaccccggcgtcgtcgttacgcagctgtcgccgacgatcaagctgtcggtcagcgtcgtgggagcattcggcaagtccttcaaggcgaagttcgcgacgacggggacggtcgttccgctgccgacgcctacgatcgctaatccattcattatcgaagcggagaacctcgacgtagtctccacttcggatagccgcacgattaataacgttgcaattgcaagcggcggcaaagacagtctgtttaatggcaatcagatcaatgattatatcgattacaaggtgaatgtgcctaaggcaggaacctacaaaatgacgttccggctatatagacagtactcccacgcgctctatcaactcaaaatcggagatacggattacggtgctccgttcgatacgtattctacggcagccaactattacgatttggatatgggggtacataccttcaattcgccgggggatcgtatattcagactgacgatggtggggagcgtagtcagcaagatcagaatcgattacatcaagctggagccgaccgagtcgttcgtcaaaggcgtcaacttcggcggcagcgccgtcacgatcgagggcaacagctgggtatcgcagagcgcggccctggcctcgggcatgacgatcacgtctaacaatcaagcgacgaacacggtcacgccgagcccggccgtcgatgccgacacggcggcgatgctgaactcgcatatgtggaagggctccaatatcacggtagcccagacgctcgctaacggtaactataaggtctatctatgggtcatggaggactatcagaacaattaccgaagctttgacgtcaagcttgagggaaccgtgaagggcacggtttcgccagctgctgttggcggctggaccaagtacggaccgtattccgcgacggtcagcgacggagcgctcacgatggagctcgtgaaattgacgggagaacccctattaatgggaatggccatttacagcgaataa

SEQ ID NO: 122 - protein, 1091 aa, Paenibacillus sp
MNNSKISTASKLRKRSSIAICVMMSYVMALSLMIVNPSPVAAADEYDTIREKYKETLTGSASYNTSDPDIAARITGITNKAYEVWDSMIKTPGRAQLWAEYGLGAPNTGSSGDNLTPIYANLKHMALAYSTRGSSLEGNTTLRDDIISGLDWMNTNKFFYGATYSGNWWHREIGAPQQLLAVTVLMYDDLTPTQIANYMAAIQWMADVIDGSGANRAWQSEIVALRGIVIKDSVTIARGTAGLSNIFDYVKSRDGFYEDGSFVQHNFYAYTGGYGASLLKAMSNLIYLVGGSSFDITDPDKANVYRWVYDSYEPLIYKGAMMDMVRGREISRHYEEDYVSAQDVIRAILLLSEVASPTDGLAYKRMVKDWMMQGDRLTDLLSTSSLFMFEEMTALMNNTAIAPRGELLKYKQFPGMDRAVQLRPGYGFGISMHSTRIAAFESINSENGKGWHTGDGMTYLYNNDLSQYSDNYWPTVNSYRLPGTTVLQPSTLTPEKVSDKNWVGGTDMSGIYGVTGMELHPYGQTLTAKKSWFMFDDEIVALGSGITSTDNIAVETIAENRKINSSGDNALTVNGTAKPTTLGWTENMTGVNSIHLAGNVAGSDIGYYFPGSANVAGLREARTGNWDQIGVGPNTNHTRNYLSLGLNHGVNPTNATYAYVTLPNKTSSQVSAYASNPNITILENSTDAQAVKENGMNMVGINFWNDVVKTVGLVTSNRKSSVMTKETASDFEVSVSDPTKAGRDTVDIEINKSATSIISVDPGVVVTQLSPTIKLSVSVVGAFGKSFKAKFATTGTVVPLPTPTIANPFIIEAENLDVVSTSDSRTINNVAIASGGKDSLFNGNQINDYIDYKVNVPKAGTYKMTFRLYRQYSHALYQLKIGDTDYGAPFDTYSTAANYYDLDMGVHTFNSPGDRIFRLTMVGSVVSKIRIDYIKLEPTESFVKGVNFGGSAVTIEGNSWVSQSAALASGMTITSNNQATNTVTPSPAVDADTAAMLNSHMWKGSNITVAQTLANGNYKVYLWVMEDYQNNYRSFDVKLEGTVKGTVSPAAVGGWTKYGPYSATVSDGALTMELVKLTGEPLLMGMAIYSE

SEQ ID NO: 123 - DNA, 3255 bp, Artificial Sequence
  Synthetic construct
  CDS (1)..(3252)
  sig_peptide (1)..(81)
  mat_peptide (82)..(3252)
atgaagaaaccgttggggaaaattgtcgcaagcaccgcactactcatttctgttgcttttagttcatcgatagcatcagcacatcatcatcaccatcatcctagggcggacgaatacgacacgattagggagaaatataaggaaacgttaacaggaagcgcgtcctacaacacgtctgatcccgatattgccgcaagaattacgggaataaccaataaagcctatgaagtatgggactccatgatcaaaacacctggtcgggcgcagctgtgggcggaatatgggcttggtgcacccaatacggggagtagtggggataatctaacgcccatttacgcgaatctcaaacatatggctcttgcctattcgacgagaggctcgagcttagaaggaaatacaacgttaagagatgatattattagcggtttagattggatgaatacgaacaaattcttttacggggctacgtattcggggaactggtggcatagggaaataggggctccgcaacagcttcttgcggtaacggttctcatgtatgacgatctgacgccgacgcaaattgccaattacatggctgccattcaatggatggctgatgtcatagatggatcaggcgctaatcgggcttggcaatccgagatcgttgcgcttagagggatcgtgattaaagatagcgttacaatcgcgagaggtacggcagggctaagcaacatatttgactacgttaaaagcagagacggcttctacgaggatggctccttcgtacagcataacttctacgcctatacgggtggctacggggcatccctcctcaaagcaatgagcaatctcatctatctcgtcggagggtcttcgttcgatattacggatcccgacaaagcgaatgtctatcggtgggtctatgattcctatgagccgctgatctataaaggcgccatgatggatatggtcagaggcagagagatctcgagacactacgaggaggactatgtgtcagcccaagatgtcattcgcgcgatcctgctattgtccgaagtcgcttccccaacagatggattagcatacaagcgcatggtgaaggattggatgatgcagggagacaggttaacggatctattatcgacttcatcgctcttcatgttcgaggagatgacagcattgatgaacaatacggccatcgcgccaagaggcgaattgctgaagtacaaacagttccccggcatggatcgcgcggtgcagcttagacctgggtacgggttcggcatcagcatgcactctactcgtattgcggcgtttgaatccattaatagcgagaacggcaaaggatggcataccggagatggcatgacttatctatataacaacgatctgtcgcagtatagcgataattactggcctacggtcaattcctacagacttcctggaacgacggttctgcagccgtccactctaacgcccgagaaagtatcggataagaattgggtcggaggaacggatatgtccgggatatacggggtgacggggatggagctgcatccatacggtcagacccttacggccaagaagtcctggttcatgttcgacgacgagatcgtggctttgggctcggggatcacgagcaccgataacattgccgtagagacgatcgcggagaatcggaagatcaatagcagcggagacaatgcgctgaccgtgaacggcacggccaagccgacgacgctcggctggacggagaatatgacgggcgttaactccattcatctggcaggcaacgtagcgggctcggatatcggctactacttccctggatccgcgaatgttgcgggattgcgtgaagctagaaccgggaactgggatcagataggagttgggcctaatacgaaccatacgcgcaattacttgagcttgggcttgaaccatggcgtcaacccgacgaatgcgacctatgcctacgtgacgctgccgaacaagacgagttcgcaggtaagcgcctatgcgagcaatccgaatattacgatcctggagaattcgaccgatgctcaggccgtgaaggagaatggcatgaacatggtgggcatcaacttctggaacgatgtcgtcaagacggtcggcctcgtgacgtcgaaccgcaagtcttccgtcatgacgaaggagacggcgagcgacttcgaggtgtccgtatcggatccgaccaaagcgggcagagacacggtcgacattgagatcaacaagagcgcgacgagcatcatctccgtcgaccccggcgtcgtcgttacgcagctgtcgccgacgatcaagctgtcggtcagcgtcgtgggagcattcggcaagtccttcaaggcgaagttcgcgacgacggggacggtcgttccgctgccgacgcctacgatcgctaatccattcattatcgaagcggagaacctcgacgtagtctccacttcggatagccgcacgattaataacgttgcaattgcaagcggcggcaaagacagtctgtttaatggcaatcagatcaatgattatatcgattacaaggtgaatgtgcctaaggcaggaacctacaaaatgacgttccggctatatagacagtactcccacgcgctctatcaactcaaaatcggagatacggattacggtgctccgttcgatacgtattctacggcagccaactattacgatttggatatgggggtacataccttcaattcgccgggggatcgtatattcagactgacgatggtggggagcgtagtcagcaagatcagaatcgattacatcaagctggagccgaccgagtcgttcgtcaaaggcgtcaacttcggcggcagcgccgtcacgatcgagggcaacagctgggtatcgcagagcgcggccctggcctcgggcatgacgatcacgtctaacaatcaagcgacgaacacggtcacgccgagcccggccgtcgatgccgacacggcggcgatgctgaactcgcatatgtggaagggctccaatatcacggtagcccagacgctcgctaacggtaactataaggtctatctatgggtcatggaggactatcagaacaattaccgaagctttgacgtcaagcttgagggaaccgtgaagggcacggtttcgccagctgctgttggcggctggaccaagtacggaccgtattccgcgacggtcagcgacggagcgctcacgatggagctcgtgaaattgacgggagaacccctattaatgggaatggccatttacagcgaataa

SEQ ID NO: 124 - protein, 1084 aa, Artificial Sequence
  Synthetic Construct
MKKPLGKIVASTALLISVAFSSSIASAHHHHHHPRADEYDTIREKYKETLTGSASYNTSDPDIAARITGITNKAYEVWDSMIKTPGRAQLWAEYGLGAPNTGSSGDNLTPIYANLKHMALAYSTRGSSLEGNTTLRDDIISGLDWMNTNKFFYGATYSGNWWHREIGAPQQLLAVTVLMYDDLTPTQIANYMAAIQWMADVIDGSGANRAWQSEIVALRGIVIKDSVTIARGTAGLSNIFDYVKSRDGFYEDGSFVQHNFYAYTGGYGASLLKAMSNLIYLVGGSSFDITDPDKANVYRWVYDSYEPLIYKGAMMDMVRGREISRHYEEDYVSAQDVIRAILLLSEVASPTDGLAYKRMVKDWMMQGDRLTDLLSTSSLFMFEEMTALMNNTAIAPRGELLKYKQFPGMDRAVQLRPGYGFGISMHSTRIAAFESINSENGKGWHTGDGMTYLYNNDLSQYSDNYWPTVNSYRLPGTTVLQPSTLTPEKVSDKNWVGGTDMSGIYGVTGMELHPYGQTLTAKKSWFMFDDEIVALGSGITSTDNIAVETIAENRKINSSGDNALTVNGTAKPTTLGWTENMTGVNSIHLAGNVAGSDIGYYFPGSANVAGLREARTGNWDQIGVGPNTNHTRNYLSLGLNHGVNPTNATYAYVTLPNKTSSQVSAYASNPNITILENSTDAQAVKENGMNMVGINFWNDVVKTVGLVTSNRKSSVMTKETASDFEVSVSDPTKAGRDTVDIEINKSATSIISVDPGVVVTQLSPTIKLSVSVVGAFGKSFKAKFATTGTVVPLPTPTIANPFIIEAENLDVVSTSDSRTINNVAIASGGKDSLFNGNQINDYIDYKVNVPKAGTYKMTFRLYRQYSHALYQLKIGDTDYGAPFDTYSTAANYYDLDMGVHTFNSPGDRIFRLTMVGSVVSKIRIDYIKLEPTESFVKGVNFGGSAVTIEGNSWVSQSAALASGMTITSNNQATNTVTPSPAVDADTAAMLNSHMWKGSNITVAQTLANGNYKVYLWVMEDYQNNYRSFDVKLEGTVKGTVSPAAVGGWTKYGPYSATVSDGALTMELVKLTGEPLLMGMAIYSE

SEQ ID NO: 125 - DNA, 2802 bp, Paenibacillus sp
  CDS (1)..(2799)
  sig_peptide (1)..(99)
  mat_peptide (100)..(2799)
ttggtaaacagatcgttacaacgattcacaagcgtatggctcgcagtcatcctggcaagcgtttctctctttgccctgccggtaacgaaggctcaggcggcggacgagttcgacacgctgcgtgagaagtacaaggtcatgctgaacggcggaacaacctatcctttatccgacccggatattgccgcgcgcgtcgatgccattacggtgacggcgcaggggtactggaacgccatgctgaaggatccaacccgaaatcggctttggaatgatgctcccttcggctcggattcgacctccattaccacgacttaccgacacctgtatgatatggcgctagcttacacgacatacggctcaagcctgaagggcaatgccgcgctgaaggcggatatcatcagcggcctggactggatgaatgcgaatcaattctacagcggctgcaccccataccagaattggtggcactggcaaatcggcggaccgatggcgttgaacgatatcgtggccttaatgtttgcggacttaacccccacgcagattgccaactacatggcggcgatttactatacccagccaagcgtgaccatgacgggggctaaccggctttgggaaagtcaggtgatcgcgatctccggcatcctgaataaggattcggccagaatcgccgcgggccgggatggggtcagcgcgctgctgccgtatgtcaccaagggcgatggattctacaacgacggatcattcgtccagcataactactatgcctacaatggcggctacggttccgagctgctcgccggcattgccgatctcatgtatatattgaacggctctacttggcaaataacggatcccaacaaaaatgcggtataccagtggatctatgattcctacgagcctttgatctacagagggaatctgatggacatggttcgcggcagggagatctccagacatggcttgcaggatgatcaagcggctgtatccgtcatggcctcgatcatccgcttgtcgcagattgccgcatccggcgatagcaccgcattcaagcgtatggtcaaatattggctgcagcaggatgcggatcttacgttccttcgagccgttccggtcgaaatgatcatagccgccaaggagattcttgcgaattccagcctacctccccgcgcggaactggtgaaatataaacaatttgccggcatggaccgcgcgctgcagctaaggcccggctacggcttcggaatcagcatgttctccagccgtatcggcaattttgagtcgatcaatgccgagaacaacaagggctggcataccggcgacggcatgacctatctgtacaataacgacctgagccaatttaacgacaattactgggccaccgtggacagctaccggctgccggggacgacggtgctgtcaaacacgacgcaagcgggcaacagccgcagtgaccaaagctgggcgggcggcacggacatcctcgggcaatacggggttaccggcatggagctgcataccgtaggcaagagcctgacggccaagaaatcctggttcatgttcgacgatgagatcgtcgcgctaggagcgggaattacgagcacggacggggtcgcagccgagacggtcgtcgagaatcgcaagcttgccggcagcggcaatcaggcgttcaccgtcaacgggaccgcgaaatctacggctcttggatggtcggaaacgatgaccggcaccaattatgtgcatctggccggcagcgtgcctggctcggatatcggctattacttccccggcggagctgcgatcaagggcttgcgtgaagcccgtacagggaactggagcgcgatcaattcgtcggcggcctggaagaacgcgacgctgcatacccgtaactatttgacgctctggatggatcatggcatcaatccgacgaatggaacgtatgcctatgtcctgcttcccaataagaccagcgccgcggtgggcagctatgccgcatcgccgaacatcagcattctggagaattccgcgtctgcccaggccgttcgggagaaccagctgaatatgaccgggattaacttctggaacgacgcgccgaccacggtgggccttgtcacctcggataagaaagcatcggtcatgaccaaggagacggccgctgatttcgaaatatcggtatccgatccaacccagcgcaatgtggggaccatctatatcgagattaacaaaagcgcaaccggtctgattgcgaaggatagcgaagtcaccgtcatccagtacaatccgaccatgaagttcaaagtaaacgtgaacaagtcgatcgggaaatcctacaagatcaagttcaatttggcgggtacgccggccaataacccttccccgattccgctgcccgatctctatgaagcggaaggcttgccggtcaacgccctaacagattcgcttaccgtaagtaatgacgcgaatgccagcggaggcaaaaagctggggttcaaccacaatgcggcggacgattatacggagttcagtctggacgttacgcagccgggcttgtacgctgtgaacgccagagtgatgaaggcgacgaatggcggaatttatcagttgtccgtgaacgggacggatgtcggaaccgcgcaggatatgtactggaacacctcggagctgtataaggacgtgaacatggggacgtatcacttcacggcgccgggaagctatttgttccgattgaagaccgttggtaagcatgccagttcatcgggctacaaaatgatgctcgactatctgcgtctgacgagtgcgaattag

SEQ ID NO: 126 - protein, 933 aa, Paenibacillus sp
LVNRSLQRFTSVWLAVILASVSLFALPVTKAQAADEFDTLREKYKVMLNGGTTYPLSDPDIAARVDAITVTAQGYWNAMLKDPTRNRLWNDAPFGSDSTSITTTYRHLYDMALAYTTYGSSLKGNAALKADIISGLDWMNANQFYSGCTPYQNWWHWQIGGPMALNDIVALMFADLTPTQIANYMAAIYYTQPSVTMTGANRLWESQVIAISGILNKDSARIAAGRDGVSALLPYVTKGDGFYNDGSFVQHNYYAYNGGYGSELLAGIADLMYILNGSTWQITDPNKNAVYQWIYDSYEPLIYRGNLMDMVRGREISRHGLQDDQAAVSVMASIIRLSQIAASGDSTAFKRMVKYWLQQDADLTFLRAVPVEMIIAAKEILANSSLPPRAELVKYKQFAGMDRALQLRPGYGFGISMFSSRIGNFESINAENNKGWHTGDGMTYLYNNDLSQFNDNYWATVDSYRLPGTTVLSNTTQAGNSRSDQSWAGGTDILGQYGVTGMELHTVGKSLTAKKSWFMFDDEIVALGAGITSTDGVAAETVVENRKLAGSGNQAFTVNGTAKSTALGWSETMTGTNYVHLAGSVPGSDIGYYFPGGAAIKGLREARTGNWSAINSSAAWKNATLHTRNYLTLWMDHGINPTNGTYAYVLLPNKTSAAVGSYAASPNISILENSASAQAVRENQLNMTGINFWNDAPTTVGLVTSDKKASVMTKETAADFEISVSDPTQRNVGTIYIEINKSATGLIAKDSEVTVIQYNPTMKFKVNVNKSIGKSYKIKFNLAGTPANNPSPIPLPDLYEAEGLPVNALTDSLTVSNDANASGGKKLGFNHNAADDYTEFSLDVTQPGLYAVNARVMKATNGGIYQLSVNGTDVGTAQDMYWNTSELYKDVNMGTYHFTAPGSYLFRLKTVGKHASSSGYKMMLDYLRLTSAN

SEQ ID NO: 127 - DNA, 2808 bp, Artificial Sequence
  Synthetic construct
  CDS (1)..(2805)
  sig_peptide (1)..(81)
  mat_peptide (82)..(2805)
atgaagaaaccgttggggaaaattgtcgcaagcaccgcactactcatttctgttgcttttagttcatcgatagcatcagcacatcatcatcaccatcatcctagggcggacgagttcgacacgctgcgtgagaagtacaaggtcatgctgaacggcggaacaacctatcctttatccgacccggatattgccgcgcgcgtcgatgccattacggtgacggcgcaggggtactggaacgccatgctgaaggatccaacccgaaatcggctttggaatgatgctcccttcggctcggattcgacctccattaccacgacttaccgacacctgtatgatatggcgctagcttacacgacatacggctcaagcctgaagggcaatgccgcgctgaaggcggatatcatcagcggcctggactggatgaatgcgaatcaattctacagcggctgcaccccataccagaattggtggcactggcaaatcggcggaccgatggcgttgaacgatatcgtggccttaatgtttgcggacttaacccccacgcagattgccaactacatggcggcgatttactatacccagccaagcgtgaccatgacgggggctaaccggctttgggaaagtcaggtgatcgcgatctccggcatcctgaataaggattcggccagaatcgccgcgggccgggatggggtcagcgcgctgctgccgtatgtcaccaagggcgatggattctacaacgacggatcattcgtccagcataactactatgcctacaatggcggctacggttccgagctgctcgccggcattgccgatctcatgtatatattgaacggctctacttggcaaataacggatcccaacaaaaatgcggtataccagtggatctatgattcctacgagcctttgatctacagagggaatctgatggacatggttcgcggcagggagatctccagacatggcttgcaggatgatcaagcggctgtatccgtcatggcctcgatcatccgcttgtcgcagattgccgcatccggcgatagcaccgcattcaagcgtatggtcaaatattggctgcagcaggatgcggatcttacgttccttcgagccgttccggtcgaaatgatcatagccgccaaggagattcttgcgaattccagcctacctccccgcgcggaactggtgaaatataaacaatttgccggcatggaccgcgcgctgcagctaaggcccggctacggcttcggaatcagcatgttctccagccgtatcggcaattttgagtcgatcaatgccgagaacaacaagggctggcataccggcgacggcatgacctatctgtacaataacgacctgagccaatttaacgacaattactgggccaccgtggacagctaccggctgccggggacgacggtgctgtcaaacacgacgcaagcgggcaacagccgcagtgaccaaagctgggcgggcggcacggacatcctcgggcaatacggggttaccggcatggagctgcataccgtaggcaagagcctgacggccaagaaatcctggttcatgttcgacgatgagatcgtcgcgctaggagcgggaattacgagcacggacggggtcgcagccgagacggtcgtcgagaatcgcaagcttgccggcagcggcaatcaggcgttcaccgtcaacgggaccgcgaaatctacggctcttggatggtcggaaacgatgaccggcaccaattatgtgcatctggccggcagcgtgcctggctcggatatcggctattacttccccggcggagctgcgatcaagggcttgcgtgaagcccgtacagggaactggagcgcgatcaattcgtcggcggcctggaagaacgcgacgctgcatacccgtaactatttgacgctctggatggatcatggcatcaatccgacgaatggaacgtatgcctatgtcctgcttcccaataagaccagcgccgcggtgggcagctatgccgcatcgccgaacatcagcattctggagaattccgcgtctgcccaggccgttcgggagaaccagctgaatatgaccgggattaacttctggaacgacgcgccgaccacggtgggccttgtcacctcggataagaaagcatcggtcatgaccaaggagacggccgctgatttcgaaatatcggtatccgatccaacccagcgcaatgtggggaccatctatatcgagattaacaaaagcgcaaccggtctgattgcgaaggatagcgaagtcaccgtcatccagtacaatccgaccatgaagttcaaagtaaacgtgaacaagtcgatcgggaaatcctacaagatcaagttcaatttggcgggtacgccggccaataacccttccccgattccgctgcccgatctctatgaagcggaaggcttgccggtcaacgccctaacagattcgcttaccgtaagtaatgacgcgaatgccagcggaggcaaaaagctggggttcaaccacaatgcggcggacgattatacggagttcagtctggacgttacgcagccgggcttgtacgctgtgaacgccagagtgatgaaggcgacgaatggcggaatttatcagttgtccgtgaacgggacggatgtcggaaccgcgcaggatatgtactggaacacctcggagctgtataaggacgtgaacatggggacgtatcacttcacggcgccgggaagctatttgttccgattgaagaccgttggtaagcatgccagttcatcgggctacaaaatgatgctcgactatctgcgtctgacgagtgcgaattag

SEQ ID NO: 128 - protein, 935 aa, Artificial Sequence
  Synthetic Construct
MKKPLGKIVASTALLISVAFSSSIASAHHHHHHPRADEFDTLREKYKVMLNGGTTYPLSDPDIAARVDAITVTAQGYWNAMLKDPTRNRLWNDAPFGSDSTSITTTYRHLYDMALAYTTYGSSLKGNAALKADIISGLDWMNANQFYSGCTPYQNWWHWQIGGPMALNDIVALMFADLTPTQIANYMAAIYYTQPSVTMTGANRLWESQVIAISGILNKDSARIAAGRDGVSALLPYVTKGDGFYNDGSFVQHNYYAYNGGYGSELLAGIADLMYILNGSTWQITDPNKNAVYQWIYDSYEPLIYRGNLMDMVRGREISRHGLQDDQAAVSVMASIIRLSQIAASGDSTAFKRMVKYWLQQDADLTFLRAVPVEMIIAAKEILANSSLPPRAELVKYKQFAGMDRALQLRPGYGFGISMFSSRIGNFESINAENNKGWHTGDGMTYLYNNDLSQFNDNYWATVDSYRLPGTTVLSNTTQAGNSRSDQSWAGGTDILGQYGVTGMELHTVGKSLTAKKSWFMFDDEIVALGAGITSTDGVAAETVVENRKLAGSGNQAFTVNGTAKSTALGWSETMTGTNYVHLAGSVPGSDIGYYFPGGAAIKGLREARTGNWSAINSSAAWKNATLHTRNYLTLWMDHGINPTNGTYAYVLLPNKTSAAVGSYAASPNISILENSASAQAVRENQLNMTGINFWNDAPTTVGLVTSDKKASVMTKETAADFEISVSDPTQRNVGTIYIEINKSATGLIAKDSEVTVIQYNPTMKFKVNVNKSIGKSYKIKFNLAGTPANNPSPIPLPDLYEAEGLPVNALTDSLTVSNDANASGGKKLGFNHNAADDYTEFSLDVTQPGLYAVNARVMKATNGGIYQLSVNGTDVGTAQDMYWNTSELYKDVNMGTYHFTAPGSYLFRLKTVGKHASSSGYKMMLDYLRLTSAN

SEQ ID NO: 129 - DNA, 2847 bp, Microbacterium sp
  CDS (1)..(2844)
  sig_peptide (1)..(96)
  mat_peptide (97)..(2844)
atgactcgacgacgagcgagaatctggataggcggggcgacctccctcgccctggccgcgggaggagcgttcgtggccgcctcgccggctctggccgcgacgatcacacaggtcgcggtgagccaggcgggatatagcgcaagcgggttgaaggtgggttccgtcgtcgcggacggcccgctcgcgcccggcacgtcgtgtcgagttcttgaaggctccaccgtcgtcgtcccgtcctgtgcgctgaacgacgagggagtcgtgtggggcgaccgcgtctacaccgtggacttcaccgccctcgacactgtcggtaccgactacgttctcgaggtcgacggggtcgcctccccccacttccagatccaggacaacgtgtgggccggctacctcgatgagatgacggcgttctaccgactgcagcgctcaggtgtcgccaccgccgacgtgtacccgagtggctacagcagcatcgctccctccgcgaaggcgttccacggccccggccacctggacgacgccgcatcggaagacgggacgatccactacgacctcaccggtgggtggtacgacgccggcgactacggcatctacggcggcaatcagtgggtggggggcaacatcgccgtcagctacctgcggtacggggacacaccggcggtgtcgttcgacaacgacagcaacggcgttcccgacctcgtcgacgaggctcgcttcggtagcgaatacctcctccggatgctggatgccttcgacggcgggttctgggacgtgaagggcagcgggagcttccagcaccccgacaagcacaccgacggcatcgtgggcacgaaagacgaccgacggatctccggctacggcgtcggaggatcagcgaaagccgcgggaaccttggccgccacggctcgagctgtcgagaaggcgctcgacgacggagcgatccccgcggccgcggtgacggagtgggaggctttcgccgcgcggagccgtgcgggcgccgaagccttctacacctatgccgacacccaccgatccgaccccctcggcggatactccaccacgcggggcggcctcgacaactccttgctgttcgccgaagtcgagctgcacctcctgaccggagacgcgggctacaaggactccgccgaagccacgatcgcggcgaccgatttcaccatcctctccaacacgaactactgggacctcgcgccgctgtcgatggccgagttgtaccccgccgcttcgcccacggcccaggcgcagatccagtcgtacctgaagaagcagttggactacttcctcaccagcacggatgacaccccttacggcgtggtggaccagttcaagaacttcggggtcaacgagccgcatgtctcctacgtcgcggatgccctccgctactacgagctcttcggcgacgagcgcgcactggaagccgtccagcgcggcttgtactgggtgttcggcaacaacccctgggggacgagctgggtctccggagtcggcgagaagagcacgaagttccttcacacccgactggacgaggacgcccagaaccaggcgggtacaggaatcgtcatccccggcgctctcgtcagcggccccaacgccaaagaccctctcgacgtgaagagtggaagcccgtggtacgcggaccgccccgtctggcaggacagtggacagcagtggcggtacaacgaatacagcgtgagcattcaaacgggcctgttctccgccctgttcgggctgaccgcagtcggcgatgccccgtgggacgggggcacggaccccgcgcccctcgcggtgacgtcaccgcagaccggggactatgtcaccggcgacgtcaccgtcttcgcggacagtggtctcagcggtctcgcgctcggccccaattgggcccccatggcgacctccgccggcgtcgccaccggttccttcaacgtgaacggtgtcgctccgtacacgaacgcacgtgtggacgtgcgcggcacgcaggccgatggttcgcaggtctactcgtcggcgcattacacggtggctccaccgctcccgaacccgggcagtcccctgctgtacgacgggttcggcaaggacggcctgttcggagttcaggggtacgcctgggcgaattggtacaacaaccacgcgggggtcggttccgtcacgaacacgacggtcgatgggcgcacggtggggcggttcttccagaacccggcgacctccgcctcgcaggcgaagttccagccctggcatcactcggtggatgcgagcggataccgctatctcaccgtgacgatgcgctcgccttcgccgaacctgcgcttgcgcatcgaggtctccgacgcggactcgaaccaccgggtaaccggcaccgcaccgatcgccgtgtccaatggctggaacacctactcgttcgacctggcagcgttccccggcctggaccggtcgcaggcgaagatggtgttctggctgcagcagaccgcggacacggacggcgaactcctcgtggacgaagtcagcttcacgaaccaggcgagtggaaccgcgccgaccctgacggcgatctcccacaccggtgggtcgctgacgacggacgacgacgtcaccgttcaagcgacctacacggacgcgaacggtgaggcgccccacaaggtccagctggtcctggacggggtggttcgggacatgactgcggtcgattcatccgacaccgacgtgagtgacggaaaggtttattcgctcaccgggaagtgggtgaagggcgcgcacagctacttcgtacgcaccacggacaccacctctgaggtggtgtcctccccacccacgacgggggtggtcgttcagtag

SEQ ID NO: 130 - protein, 948 aa, Microbacterium sp
MTRRRARIWIGGATSLALAAGGAFVAASPALAATITQVAVSQAGYSASGLKVGSVVADGPLAPGTSCRVLEGSTVVVPSCALNDEGVVWGDRVYTVDFTALDTVGTDYVLEVDGVASPHFQIQDNVWAGYLDEMTAFYRLQRSGVATADVYPSGYSSIAPSAKAFHGPGHLDDAASEDGTIHYDLTGGWYDAGDYGIYGGNQWVGGNIAVSYLRYGDTPAVSFDNDSNGVPDLVDEARFGSEYLLRMLDAFDGGFWDVKGSGSFQHPDKHTDGIVGTKDDRRISGYGVGGSAKAAGTLAATARAVEKALDDGAIPAAAVTEWEAFAARSRAGAEAFYTYADTHRSDPLGGYSTTRGGLDNSLLFAEVELHLLTGDAGYKDSAEATIAATDFTILSNTNYWDLAPLSMAELYPAASPTAQAQIQSYLKKQLDYFLTSTDDTPYGVVDQFKNFGVNEPHVSYVADALRYYELFGDERALEAVQRGLYWVFGNNPWGTSWVSGVGEKSTKFLHTRLDEDAQNQAGTGIVIPGALVSGPNAKDPLDVKSGSPWYADRPVWQDSGQQWRYNEYSVSIQTGLFSALFGLTAVGDAPWDGGTDPAPLAVTSPQTGDYVTGDVTVFADSGLSGLALGPNWAPMATSAGVATGSFNVNGVAPYTNARVDVRGTQADGSQVYSSAHYTVAPPLPNPGSPLLYDGFGKDGLFGVQGYAWANWYNNHAGVGSVTNTTVDGRTVGRFFQNPATSASQAKFQPWHHSVDASGYRYLTVTMRSPSPNLRLRIEVSDADSNHRVTGTAPIAVSNGWNTYSFDLAAFPGLDRSQAKMVFWLQQTADTDGELLVDEVSFTNQASGTAPTLTAISHTGGSLTTDDDVTVQATYTDANGEAPHKVQLVLDGVVRDMTAVDSSDTDVSDGKVYSLTGKWVKGAHSYFVRTTDTTSEVVSSPPTTGVVVQ

SEQ ID NO: 131 - DNA, 2856 bp, Artificial Sequence
  Synthetic construct
  CDS (1)..(2853)
  sig_peptide (1)..(81)
  mat_peptide (82)..(2844)
atgaagaaaccgttggggaaaattgtcgcaagcaccgcactactcatttctgttgcttttagttcatcgatagcatcagcacatcatcatcaccatcatcctagggcgacgatcacacaggtcgcggtgagccaggcgggatatagcgcaagcgggttgaaggtgggttccgtcgtcgcggacggcccgctcgcgcccggcacgtcgtgtcgagttcttgaaggctccaccgtcgtcgtcccgtcctgtgcgctgaacgacgagggagtcgtgtggggcgaccgcgtctacaccgtggacttcaccgccctcgacactgtcggtaccgactacgttctcgaggtcgacggggtcgcctccccccacttccagatccaggacaacgtgtgggccggctacctcgatgagatgacggcgttctaccgactgcagcgctcaggtgtcgccaccgccgacgtgtacccgagtggctacagcagcatcgctccctccgcgaaggcgttccacggccccggccacctggacgacgccgcatcggaagacgggacgatccactacgacctcaccggtgggtggtacgacgccggcgactacggcatctacggcggcaatcagtgggtggggggcaacatcgccgtcagctacctgcggtacggggacacaccggcggtgtcgttcgacaacgacagcaacggcgttcccgacctcgtcgacgaggctcgcttcggtagcgaatacctcctccggatgctggatgccttcgacggcgggttctgggacgtgaagggcagcgggagcttccagcaccccgacaagcacaccgacggcatcgtgggcacgaaagacgaccgacggatctccggctacggcgtcggaggatcagcgaaagccgcgggaaccttggccgccacggctcgagctgtcgagaaggcgctcgacgacggagcgatccccgcggccgcggtgacggagtgggaggctttcgccgcgcggagccgtgcgggcgccgaagccttctacacctatgccgacacccaccgatccgaccccctcggcggatactccaccacgcggggcggcctcgacaactccttgctgttcgccgaagtcgagctgcacctcctgaccggagacgcgggctacaaggactccgccgaagccacgatcgcggcgaccgatttcaccatcctctccaacacgaactactgggacctcgcgccgctgtcgatggccgagttgtaccccgccgcttcgcccacggcccaggcgcagatccagtcgtacctgaagaagcagttggactacttcctcaccagcacggatgacaccccttacggcgtggtggaccagttcaagaacttcggggtcaacgagccgcatgtctcctacgtcgcggatgccctccgctactacgagctcttcggcgacgagcgcgcactggaagccgtccagcgcggcttgtactgggtgttcggcaacaacccctgggggacgagctgggtctccggagtcggcgagaagagcacgaagttccttcacacccgactggacgaggacgcccagaaccaggcgggtacaggaatcgtcatccccggcgctctcgtcagcggccccaacgccaaagaccctctcgacgtgaagagtggaagcccgtggtacgcggaccgccccgtctggcaggacagtggacagcagtggcggtacaacgaatacagcgtgagcattcaaacgggcctgttctccgccctgttcgggctgaccgcagtcggcgatgccccgtgggacgggggcacggaccccgcgcccctcgcggtgacgtcaccgcagaccggggactatgtcaccggcgacgtcaccgtcttcgcggacagtggtctcagcggtctcgcgctcggccccaattgggcccccatggcgacctccgccggcgtcgccaccggttccttcaacgtgaacggtgtcgctccgtacacgaacgcacgtgtggacgtgcgcggcacgcaggccgatggttcgcaggtctactcgtcggcgcattacacggtggctccaccgctcccgaacccgggcagtcccctgctgtacgacgggttcggcaaggacggcctgttcggagttcaggggtacgcctgggcgaattggtacaacaaccacgcgggggtcggttccgtcacgaacacgacggtcgatgggcgcacggtggggcggttcttccagaacccggcgacctccgcctcgcaggcgaagttccagccctggcatcactcggtggatgcgagcggataccgctatctcaccgtgacgatgcgctcgccttcgccgaacctgcgcttgcgcatcgaggtctccgacgcggactcgaaccaccgggtaaccggcaccgcaccgatcgccgtgtccaatggctggaacacctactcgttcgacctggcagcgttccccggcctggaccggtcgcaggcgaagatggtgttctggctgcagcagaccgcggacacggacggcgaactcctcgtggacgaagtcagcttcacgaaccaggcgagtggaaccgcgccgaccctgacggcgatctcccacaccggtgggtcgctgacgacggacgacgacgtcaccgttcaagcgacctacacggacgcgaacggtgaggcgccccacaaggtccagctggtcctggacggggtggttcgggacatgactgcggtcgattcatccgacaccgacgtgagtgacggaaaggtttattcgctcaccgggaagtgggtgaagggcgcgcacagctacttcgtacgcaccacggacaccacctctgaggtggtgtcctccccacccacgacgggggtggtcgttcagtag

SEQ ID NO: 132 - protein, 951 aa, Artificial Sequence
  Synthetic Construct
MKKPLGKIVASTALLISVAFSSSIASAHHHHHHPRATITQVAVSQAGYSASGLKVGSVVADGPLAPGTSCRVLEGSTVVVPSCALNDEGVVWGDRVYTVDFTALDTVGTDYVLEVDGVASPHFQIQDNVWAGYLDEMTAFYRLQRSGVATADVYPSGYSSIAPSAKAFHGPGHLDDAASEDGTIHYDLTGGWYDAGDYGIYGGNQWVGGNIAVSYLRYGDTPAVSFDNDSNGVPDLVDEARFGSEYLLRMLDAFDGGFWDVKGSGSFQHPDKHTDGIVGTKDDRRISGYGVGGSAKAAGTLAATARAVEKALDDGAIPAAAVTEWEAFAARSRAGAEAFYTYADTHRSDPLGGYSTTRGGLDNSLLFAEVELHLLTGDAGYKDSAEATIAATDFTILSNTNYWDLAPLSMAELYPAASPTAQAQIQSYLKKQLDYFLTSTDDTPYGVVDQFKNFGVNEPHVSYVADALRYYELFGDERALEAVQRGLYWVFGNNPWGTSWVSGVGEKSTKFLHTRLDEDAQNQAGTGIVIPGALVSGPNAKDPLDVKSGSPWYADRPVWQDSGQQWRYNEYSVSIQTGLFSALFGLTAVGDAPWDGGTDPAPLAVTSPQTGDYVTGDVTVFADSGLSGLALGPNWAPMATSAGVATGSFNVNGVAPYTNARVDVRGTQADGSQVYSSAHYTVAPPLPNPGSPLLYDGFGKDGLFGVQGYAWANWYNNHAGVGSVTNTTVDGRTVGRFFQNPATSASQAKFQPWHHSVDASGYRYLTVTMRSPSPNLRLRIEVSDADSNHRVTGTAPIAVSNGWNTYSFDLAAFPGLDRSQAKMVFWLQQTADTDGELLVDEVSFTNQASGTAPTLTAISHTGGSLTTDDDVTVQATYTDANGEAPHKVQLVLDGVVRDMTAVDSSDTDVSDGKVYSLTGKWVKGAHSYFVRTTDTTSEVVSSPPTTGVVVQ

SEQ ID NO: 133 - DNA, 4233 bp, Paenibacillus sp
  CDS (1)..(4230)
  sig_peptide (1)..(111)
  mat_peptide (112)..(4230)
atgacacgttcaacgacacgctccaacaacgcccgaaggctggtatgcacaggccttggacttctgctcggttttcaagctttgactctgacacccgctatctcctcggcagccgttccgccgctgcctggacccggcagccctatcctctatgacgactttgccggaggcggacaatacaagcagaactggatgaactggtataaccagaatggcggaagcggaacgtttgcccgtacaaccgatggtacgcgcacagtgggcaaattcacgcaaacccctgcttccgcaagctcctgggccaaatttcagcccatgaatgagaccttctcggttgtcggctaccgttatttaaacctgtcgctgcgcagcccgggctatgaagatgcacttgtccgtattaatctgaatgatggtacccgaaattatgatctgactggcggctggaccagcgttccagatacgtggacggatatgcagttcgatctgaatgagctcgatcccgccatcaagaaggacaaagtcaagctggagatatggctcagacaggccggcggtcaatacggagaggtactgctggacgatatcactgcaacgacagattcaagcggcaccgctccaacgcttaccgccgtctctatgacggcaaatacagagcatgcctacaaccagaacacgatgttcaccttccagacaacgtacacagatgctgataacgagaagccatttgccattcaggtcgtgattaacgatacggcctatgatctgaaggagctcgatgctgccgacgtcacgtatactgacggcaaagcttattcctatgctaccaagctgccacccggcacccattcttactacttccgcaccacagacacgacctctaatgaagttgcgactcctcttcagccgggactaagcgtcgtacaagctgcccaactgatcgatgttgtggtgagccaagcgggctacagcgccggagacttcaaaggggccaaggttgtatcaagcaccccgcttacggatttgtcatacgagatcagaaacggaggcgctgtggcagccactggcagcatgaccgctgaaggccagcattggaaccggtacgtctattcgatcgacttcacgtccatcacgacgccaggcagcagctttacgatcaaaagcaatggcatgacttcttatccatttgccatatctactaacgtttgggatagctataaggatgagatgaccgccttctatcggctgttgcgcgcaggggttgccacagaggatgcctatccggccggttatagcagcgtggcgccgtcagccaagctttatcatggcgcaggccatcttgacgatgccgtatccatcgacggtacgacacattataatctgacaggcggctggtatgatgctggcgattatggcaaatatggcggcaaccaatgggtaggtgcccagatcgccctcgcctacctccgttatgccgactccccaagcgtcaagtacgacaacgataataacgggattcccgatttgatcgacgaagcgatattcggcagcgaatatctgattaagtttgccaaccagcttggcggagaaatgtacaatctcaagaacaacgcatcgttcgttcatccggagaaagcgaccgacaatattcccggcacggccgatgatcgcaagctttctgaccttagcgtaggcggctctgccaaatcggcggggacgcttgccgccactgcccgcgcgatccgcaccgctatcgctgacggcgacatcggtgcagcagcacaagtcgagctctcgacattcgcggatgcctgtgaagcggcggctgtcgtgttccatgagtatgtactggacaacccgaatggcccaattggctcctactctacgcgcggcggtatcgacaactccatgctgctcgccgatgtcgagctttacttgctcacgaacgaaatcgcttataagaatgcggctacagacaaaatcaatgcgcttgtcttcagcgatctcgcatcaacgaactattgggatatgcggccgatctctatggcggaattctatcccgtggcggatgctgcgacacaagcccatatccagagtctgctgaagcagcaggtcgattacttcctgtcctctacggatgacacgccgtatggcgtgctcaatcagttcaagaactttggtgtcaacgaaccgcatgcctcctacctgggcgacatgctgcgctactacgagctattcggcgatcccgctgcactgcacgccgtgcagaagggaatgtactggatttttggcgtcaatccgtggaatatcagttgggtgtcgggcattggaaccgatcatgtcgatttcctgcatacccgctttgacgaagcagcgaacacggcgggcggaaccggcatcgtgctacctggcgcaatggtcagcggtcccaacatgaaggatccgaaggacaaaagaagtataagcccttggtatgcggaccgttccatgcatcaggatgatgtaagccagtggcgttacaatgagttcagcataagtattcaggccggtctgctctatacggttatgggtctgagcgcaatgggcggtacaagctcagcgggcggctcttaccctgcagagcttccaatccaggcacctgtcatcggcgacgtggtacgcggcagcgtcacactgtttgctcaacctgatgcgaatacaaccgcgctcgaatactcagctggcggcggagcttacgcacctatgacagcatccggcgaggcttatacagccgtcatcgatgaaagcgcagccgctccttacacgaaccgcagagtcgatatcaggggcgtcgatgcgtctgggcatcacacctacagctctacccattacacagtagcaccgcctcttcctgatccatcgactccgcttctgtatgataactttgacggcagcggcgtttggggcggctcagctacaaataccaactgggtaaactggtataaccagaacggcggaaccggggcttttgccaaactaacagaaaacgggcgcaccatcggcaaattctcgcaaacgcccacatctgcaagctctgccgcgaagttccagccttggcatgatgtcgccgatttatccggctatcgttacctgaacttcaaagtcaaaaaccccgggtactcggagctgcgcacgcgcattgaagtatccgacggaagccgcacctataatcttactggcggctgggtcacggttcctgccgaatggaccgacctgcagtttgatctcaacgctctcgtgccggcgattaacaaaaaaagcctgaagctctccatctggctgaagcagaatgctgtcggctatggtgaaatgctgatggacgacatcaccgccagcaatacggcttctggcagcgcgcctgcactaggcggagcaagtatcgatgcggcaagcggaaatccgttaacgccgtttacctttaacgtgacctacacagatgcagacaacgaagctccttttgcaatggagctggtgctggatggcgtgatccgccaaatgattcccgtcgatatgaacgatacgaactattcggatggaaaagcttatatgtatacaacgacactgccagcaggcgaacactcctactatttccacacaaccgataccagctcggatgcggtcagcacagctgtcatggcagggccgacggttgctgagaatcaggtgccagcgctgctgctggagaattttgacgacggaacggcggatggatggtcggcaacaagcggagtctgggccgtacagaacggtcaatacagcgggacggcagccagtggaaacagctattcgttggcaggagactccagctggacggattacacgctggaagccaaggttaatgtgacgaataatacgggaggcaataaggatgcggggctagcgtttcgatatacggatgcgaacaaccattacgtcctgtatttgaagaacaatgaccgaaccgggcgcaagatggagctggtcaaagtcgtgaacggcgtcaaaaccacgctcgcccacgccagcccttctatcacggccgacaccttctacacgtacagaatagtcgctgacggagcggaaatatccgtttatcaggacgatacgctcattcttagtgcatcggacagcgcccacaccagcggcggaattgccgcacgcgtgtacgcgagcacgaaggcactgttcgatgatattagcgtgactcccttctag

SEQ ID NO: 134 - protein, 1410 aa, Paenibacillus sp
MTRSTTRSNNARRLVCTGLGLLLGFQALTLTPAISSAAVPPLPGPGSPILYDDFAGGGQYKQNWMNWYNQNGGSGTFARTTDGTRTVGKFTQTPASASSWAKFQPMNETFSVVGYRYLNLSLRSPGYEDALVRINLNDGTRNYDLTGGWTSVPDTWTDMQFDLNELDPAIKKDKVKLEIWLRQAGGQYGEVLLDDITATTDSSGTAPTLTAVSMTANTEHAYNQNTMFTFQTTYTDADNEKPFAIQVVINDTAYDLKELDAADVTYTDGKAYSYATKLPPGTHSYYFRTTDTTSNEVATPLQPGLSVVQAAQLIDVVVSQAGYSAGDFKGAKVVSSTPLTDLSYEIRNGGAVAATGSMTAEGQHWNRYVYSIDFTSITTPGSSFTIKSNGMTSYPFAISTNVWDSYKDEMTAFYRLLRAGVATEDAYPAGYSSVAPSAKLYHGAGHLDDAVSIDGTTHYNLTGGWYDAGDYGKYGGNQWVGAQIALAYLRYADSPSVKYDNDNNGIPDLIDEAIFGSEYLIKFANQLGGEMYNLKNNASFVHPEKATDNIPGTADDRKLSDLSVGGSAKSAGTLAATARAIRTAIADGDIGAAAQVELSTFADACEAAAVVFHEYVLDNPNGPIGSYSTRGGIDNSMLLADVELYLLTNEIAYKNAATDKINALVFSDLASTNYWDMRPISMAEFYPVADAATQAHIQSLLKQQVDYFLSSTDDTPYGVLNQFKNFGVNEPHASYLGDMLRYYELFGDPAALHAVQKGMYWIFGVNPWNISWVSGIGTDHVDFLHTRFDEAANTAGGTGIVLPGAMVSGPNMKDPKDKRSISPWYADRSMHQDDVSQWRYNEFSISIQAGLLYTVMGLSAMGGTSSAGGSYPAELPIQAPVIGDVVRGSVTLFAQPDANTTALEYSAGGGAYAPMTASGEAYTAVIDESAAAPYTNRRVDIRGVDASGHHTYSSTHYTVAPPLPDPSTPLLYDNFDGSGVWGGSATNTNWVNWYNQNGGTGAFAKLTENGRTIGKFSQTPTSASSAAKFQPWHDVADLSGYRYLNFKVKNPGYSELRTRIEVSDGSRTYNLTGGWVTVPAEWTDLQFDLNALVPAINKKSLKLSIWLKQNAVGYGEMLMDDITASNTASGSAPALGGASIDAASGNPLTPFTFNVTYTDADNEAPFAMELVLDGVIRQMIPVDMNDTNYSDGKAYMYTTTLPAGEHSYYFHTTDTSSDAVSTAVMAGPTVAENQVPALLLENFDDGTADGWSATSGVWAVQNGQYSGTAASGNSYSLAGDSSWTDYTLEAKVNVTNNTGGNKDAGLAFRYTDANNHYVLYLKNNDRTGRKMELVKVVNGVKTTLAHASPSITADTFYTYRIVADGAEISVYQDDTLILSASDSAHTSGGIAARVYASTKALFDDISVTPF

SEQ ID NO: 135 - DNA, 4227 bp, Artificial Sequence
  Synthetic construct
  CDS (1)..(4224)
  sig_peptide (1)..(81)
  mat_peptide (82)..(4224)
atgaagaaaccgttggggaaaattgtcgcaagcaccgcactactcatttctgttgcttttagttcatcgatagcatcagcacatcatcatcaccatcatcctagggccgttccgccgctgcctggacccggcagccctatcctctatgacgactttgccggaggcggacaatacaagcagaactggatgaactggtataaccagaatggcggaagcggaacgtttgcccgtacaaccgatggtacgcgcacagtgggcaaattcacgcaaacccctgcttccgcaagctcctgggccaaatttcagcccatgaatgagaccttctcggttgtcggctaccgttatttaaacctgtcgctgcgcagcccgggctatgaagatgcacttgtccgtattaatctgaatgatggtacccgaaattatgatctgactggcggctggaccagcgttccagatacgtggacggatatgcagttcgatctgaatgagctcgatcccgccatcaagaaggacaaagtcaagctggagatatggctcagacaggccggcggtcaatacggagaggtactgctggacgatatcactgcaacgacagattcaagcggcaccgctccaacgcttaccgccgtctctatgacggcaaatacagagcatgcctacaaccagaacacgatgttcaccttccagacaacgtacacagatgctgataacgagaagccatttgccattcaggtcgtgattaacgatacggcctatgatctgaaggagctcgatgctgccgacgtcacgtatactgacggcaaagcttattcctatgctaccaagctgccacccggcacccattcttactacttccgcaccacagacacgacctctaatgaagttgcgactcctcttcagccgggactaagcgtcgtacaagctgcccaactgatcgatgttgtggtgagccaagcgggctacagcgccggagacttcaaaggggccaaggttgtatcaagcaccccgcttacggatttgtcatacgagatcagaaacggaggcgctgtggcagccactggcagcatgaccgctgaaggccagcattggaaccggtacgtctattcgatcgacttcacgtccatcacgacgccaggcagcagctttacgatcaaaagcaatggcatgacttcttatccatttgccatatctactaacgtttgggatagctataaggatgagatgaccgccttctatcggctgttgcgcgcaggggttgccacagaggatgcctatccggccggttatagcagcgtggcgccgtcagccaagctttatcatggcgcaggccatcttgacgatgccgtatccatcgacggtacgacacattataatctgacaggcggctggtatgatgctggcgattatggcaaatatggcggcaaccaatgggtaggtgcccagatcgccctcgcctacctccgttatgccgactccccaagcgtcaagtacgacaacgataataacgggattcccgatttgatcgacgaagcgatattcggcagcgaatatctgattaagtttgccaaccagcttggcggagaaatgtacaatctcaagaacaacgcatcgttcgttcatccggagaaagcgaccgacaatattcccggcacggccgatgatcgcaagctttctgaccttagcgtaggcggctctgccaaatcggcggggacgcttgccgccactgcccgcgcgatccgcaccgctatcgctgacggcgacatcggtgcagcagcacaagtcgagctctcgacattcgcggatgcctgtgaagcggcggctgtcgtgttccatgagtatgtactggacaacccgaatggcccaattggctcctactctacgcgcggcggtatcgacaactccatgctgctcgccgatgtcgagctttacttgctcacgaacgaaatcgcttataagaatgcggctacagacaaaatcaatgcgcttgtcttcagcgatctcgcatcaacgaactattgggatatgcggccgatctctatggcggaattctatcccgtggcggatgctgcgacacaagcccatatccagagtctgctgaagcagcaggtcgattacttcctgtcctctacggatgacacgccgtatggcgtgctcaatcagttcaagaactttggtgtcaacgaaccgcatgcctcctacctgggcgacatgctgcgctactacgagctattcggcgatcccgctgcactgcacgccgtgcagaagggaatgtactggatttttggcgtcaatccgtggaatatcagttgggtgtcgggcattggaaccgatcatgtcgatttcctgcatacccgctttgacgaagcagcgaacacggcgggcggaaccggcatcgtgctacctggcgcaatggtcagcggtcccaacatgaaggatccgaaggacaaaagaagtataagcccttggtatgcggaccgttccatgcatcaggatgatgtaagccagtggcgttacaatgagttcagcataagtattcaggccggtctgctctatacggttatgggtctgagcgcaatgggcggtacaagctcagcgggcggctcttaccctgcagagcttccaatccaggcacctgtcatcggcgacgtggtacgcggcagcgtcacactgtttgctcaacctgatgcgaatacaaccgcgctcgaatactcagctggcggcggagcttacgcacctatgacagcatccggcgaggcttatacagccgtcatcgatgaaagcgcagccgctccttacacgaaccgcagagtcgatatcaggggcgtcgatgcgtctgggcatcacacctacagctctacccattacacagtagcaccgcctcttcctgatccatcgactccgcttctgtatgataactttgacggcagcggcgtttggggcggctcagctacaaataccaactgggtaaactggtataaccagaacggcggaaccggggcttttgccaaactaacagaaaacgggcgcaccatcggcaaattctcgcaaacgcccacatctgcaagctctgccgcgaagttccagccttggcatgatgtcgccgatttatccggctatcgttacctgaacttcaaagtcaaaaaccccgggtactcggagctgcgcacgcgcattgaagtatccgacggaagccgcacctataatcttactggcggctgggtcacggttcctgccgaatggaccgacctgcagtttgatctcaacgctctcgtgccggcgattaacaaaaaaagcctgaagctctccatctggctgaagcagaatgctgtcggctatggtgaaatgctgatggacgacatcaccgccagcaatacggcttctggcagcgcgcctgcactaggcggagcaagtatcgatgcggcaagcggaaatccgttaacgccgtttacctttaacgtgacctacacagatgcagacaacgaagctccttttgcaatggagctggtgctggatggcgtgatccgccaaatgattcccgtcgatatgaacgatacgaactattcggatggaaaagcttatatgtatacaacgacactgccagcaggcgaacactcctactatttccacacaaccgataccagctcggatgcggtcagcacagctgtcatggcagggccgacggttgctgagaatcaggtgccagcgctgctgctggagaattttgacgacggaacggcggatggatggtcggcaacaagcggagtctgggccgtacagaacggtcaatacagcgggacggcagccagtggaaacagctattcgttggcaggagactccagctggacggattacacgctggaagccaaggttaatgtgacgaataatacgggaggcaataaggatgcggggctagcgtttcgatatacggatgcgaacaaccattacgtcctgtatttgaagaacaatgaccgaaccgggcgcaagatggagctggtcaaagtcgtgaacggcgtcaaaaccacgctcgcccacgccagcccttctatcacggccgacaccttctacacgtacagaatagtcgctgacggagcggaaatatccgtttatcaggacgatacgctcattcttagtgcatcggacagcgcccacaccagcggcggaattgccgcacgcgtgtacgcgagcacgaaggcactgttcgatgatattagcgtgactcccttctaa

SEQ ID NO: 136 - protein, 1408 aa, Artificial Sequence
  Synthetic Construct
MKKPLGKIVASTALLISVAFSSSIASAHHHHHHPRAVPPLPGPGSPILYDDFAGGGQYKQNWMNWYNQNGGSGTFARTTDGTRTVGKFTQTPASASSWAKFQPMNETFSVVGYRYLNLSLRSPGYEDALVRINLNDGTRNYDLTGGWTSVPDTWTDMQFDLNELDPAIKKDKVKLEIWLRQAGGQYGEVLLDDITATTDSSGTAPTLTAVSMTANTEHAYNQNTMFTFQTTYTDADNEKPFAIQVVINDTAYDLKELDAADVTYTDGKAYSYATKLPPGTHSYYFRTTDTTSNEVATPLQPGLSVVQAAQLIDVVVSQAGYSAGDFKGAKVVSSTPLTDLSYEIRNGGAVAATGSMTAEGQHWNRYVYSIDFTSITTPGSSFTIKSNGMTSYPFAISTNVWDSYKDEMTAFYRLLRAGVATEDAYPAGYSSVAPSAKLYHGAGHLDDAVSIDGTTHYNLTGGWYDAGDYGKYGGNQWVGAQIALAYLRYADSPSVKYDNDNNGIPDLIDEAIFGSEYLIKFANQLGGEMYNLKNNASFVHPEKATDNIPGTADDRKLSDLSVGGSAKSAGTLAATARAIRTAIADGDIGAAAQVELSTFADACEAAAVVFHEYVLDNPNGPIGSYSTRGGIDNSMLLADVELYLLTNEIAYKNAATDKINALVFSDLASTNYWDMRPISMAEFYPVADAATQAHIQSLLKQQVDYFLSSTDDTPYGVLNQFKNFGVNEPHASYLGDMLRYYELFGDPAALHAVQKGMYWIFGVNPWNISWVSGIGTDHVDFLHTRFDEAANTAGGTGIVLPGAMVSGPNMKDPKDKRSISPWYADRSMHQDDVSQWRYNEFSISIQAGLLYTVMGLSAMGGTSSAGGSYPAELPIQAPVIGDVVRGSVTLFAQPDANTTALEYSAGGGAYAPMTASGEAYTAVIDESAAAPYTNRRVDIRGVDASGHHTYSSTHYTVAPPLPDPSTPLLYDNFDGSGVWGGSATNTNWVNWYNQNGGTGAFAKLTENGRTIGKFSQTPTSASSAAKFQPWHDVADLSGYRYLNFKVKNPGYSELRTRIEVSDGSRTYNLTGGWVTVPAEWTDLQFDLNALVPAINKKSLKLSIWLKQNAVGYGEMLMDDITASNTASGSAPALGGASIDAASGNPLTPFTFNVTYTDADNEAPFAMELVLDGVIRQMIPVDMNDTNYSDGKAYMYTTTLPAGEHSYYFHTTDTSSDAVSTAVMAGPTVAENQVPALLLENFDDGTADGWSATSGVWAVQNGQYSGTAASGNSYSLAGDSSWTDYTLEAKVNVTNNTGGNKDAGLAFRYTDANNHYVLYLKNNDRTGRKMELVKVVNGVKTTLAHASPSITADTFYTYRIVADGAEISVYQDDTLILSASDSAHTSGGIAARVYASTKALFDDISVTPF

SEQ ID NO: 137 - DNA, 3726 bp, Paenibacillus sp
  CDS (1)..(3723)
  sig_peptide (1)..(111)
  mat_peptide (112)..(3723)
atgacacgttcaacgacacgctccaacaacgcccgaaggctggtatgcacaggccttggacttctgctcggttttcaagctttgactctgacacccgctatctcctcggcagccgttccgccgctgcctggacccggcagccctatcctctatgacgactttgccggaggcggacaatacaagcagaactggatgaactggtataaccagaatggcggaagcggaacgtttgcccgtacaaccgatggtacgcgcacagtgggcaaattcacgcaaacccctgcttccgcaagctcctgggccaaatttcagcccatgaatgagaccttctcggttgtcggctaccgttatttaaacctgtcgctgcgcagcccgggctatgaagatgcacttgtccgtattaatctgaatgatggtacccgaaattatgatctgactggcggctggaccagcgttccagatacgtggacggatatgcagttcgatctgaatgagctcgatcccgccatcaagaaggacaaagtcaagctggagatatggctcagacaggccggcggtcaatacggagaggtactgctggacgatatcactgcaacgacagattcaagcggcaccgctccaacgcttaccgccgtctctatgacggcaaatacagagcatgcctacaaccagaacacgatgttcaccttccagacaacgtacacagatgctgataacgagaagccatttgccattcaggtcgtgattaacgatacggcctatgatctgaaggagctcgatgctgccgacgtcacgtatactgacggcaaagcttattcctatgctaccaagctgccacccggcacccattcttactacttccgcaccacagacacgacctctaatgaagttgcgactcctcttcagccgggactaagcgtcgtacaagctgcccaactgatcgatgttgtggtgagccaagcgggctacagcgccggagacttcaaaggggccaaggttgtatcaagcaccccgcttacggatttgtcatacgagatcagaaacggaggcgctgtggcagccactggcagcatgaccgctgaaggccagcattggaaccggtacgtctattcgatcgacttcacgtccatcacgacgccaggcagcagctttacgatcaaaagcaatggcatgacttcttatccatttgccatatctactaacgtttgggatagctataaggatgagatgaccgccttctatcggctgttgcgcgcaggggttgccacagaggatgcctatccggccggttatagcagcgtggcgccgtcagccaagctttatcatggcgcaggccatcttgacgatgccgtatccatcgacggtacgacacattataatctgacaggcggctggtatgatgctggcgattatggcaaatatggcggcaaccaatgggtaggtgcccagatcgccctcgcctacctccgttatgccgactccccaagcgtcaagtacgacaacgataataacgggattcccgatttgatcgacgaagcgatattcggcagcgaatatctgattaagtttgccaaccagcttggcggagaaatgtacaatctcaagaacaacgcatcgttcgttcatccggagaaagcgaccgacaatattcccggcacggccgatgatcgcaagctttctgaccttagcgtaggcggctctgccaaatcggcggggacgcttgccgccactgcccgcgcgatccgcaccgctatcgctgacggcgacatcggtgcagcagcacaagtcgagctctcgacattcgcggatgcctgtgaagcggcggctgtcgtgttccatgagtatgtactggacaacccgaatggcccaattggctcctactctacgcgcggcggtatcgacaactccatgctgctcgccgatgtcgagctttacttgctcacgaacgaaatcgcttataagaatgcggctacagacaaaatcaatgcgcttgtcttcagcgatctcgcatcaacgaactattgggatatgcggccgatctctatggcggaattctatcccgtggcggatgctgcgacacaagcccatatccagagtctgctgaagcagcaggtcgattacttcctgtcctctacggatgacacgccgtatggcgtgctcaatcagttcaagaactttggtgtcaacgaaccgcatgcctcctacctgggcgacatgctgcgctactacgagctattcggcgatcccgctgcactgcacgccgtgcagaagggaatgtactggatttttggcgtcaatccgtggaatatcagttgggtgtcgggcattggaaccgatcatgtcgatttcctgcatacccgctttgacgaagcagcgaacacggcgggcggaaccggcatcgtgctacctggcgcaatggtcagcggtcccaacatgaaggatccgaaggacaaaagaagtataagcccttggtatgcggaccgttccatgcatcaggatgatgtaagccagtggcgttacaatgagttcagcataagtattcaggccggtctgctctatacggttatgggtctgagcgcaatgggcggtacaagctcagcgggcggctcttaccctgcagagcttccaatccaggcacctgtcatcggcgacgtggtacgcggcagcgtcacactgtttgctcaacctgatgcgaatacaaccgcgctcgaatactcagctggcggcggagcttacgcacctatgacagcatccggcgaggcttatacagccgtcatcgatgaaagcgcagccgctccttacacgaaccgcagagtcgatatcaggggcgtcgatgcgtctgggcatcacacctacagctctacccattacacagtagcaccgcctcttcctgatccatcgactccgcttctgtatgataactttgacggcagcggcgtttggggcggctcagctacaaataccaactgggtaaactggtataaccagaacggcggaaccggggcttttgccaaactaacagaaaacgggcgcaccatcggcaaattctcgcaaacgcccacatctgcaagctctgccgcgaagttccagccttggcatgatgtcgccgatttatccggctatcgttacctgaacttcaaagtcaaaaaccccgggtactcggagctgcgcacgcgcattgaagtatccgacggaagccgcacctataatcttactggcggctgggtcacggttcctgccgaatggaccgacctgcagtttgatctcaacgctctcgtgccggcgattaacaaaaaaagcctgaagctctccatctggctgaagcagaatgctgtcggctatggtgaaatgctgatggacgacatcaccgccagcaatacggcttctggcagcgcgcctgcactaggcggagcaagtatcgatgcggcaagcggaaatccgttaacgccgtttacctttaacgtgacctacacagatgcagacaacgaagctccttttgcaatggagctggtgctggatggcgtgatccgccaaatgattcccgtcgatatgaacgatacgaactattcggatggaaaagcttatatgtatacaacgacactgccagcaggcgaacactcctactatttccacacaaccgataccagctcggatgcggtcagcacagctgtcatggcagggccgacggttgctgagaatcaggtgccagcgctgctgctggagaat

SEQ ID NO: 138 - protein, 1241 aa, Paenibacillus sp
MTRSTTRSNNARRLVCTGLGLLLGFQALTLTPAISSAAVPPLPGPGSPILYDDFAGGGQYKQNWMNWYNQNGGSGTFARTTDGTRTVGKFTQTPASASSWAKFQPMNETFSVVGYRYLNLSLRSPGYEDALVRINLNDGTRNYDLTGGWTSVPDTWTDMQFDLNELDPAIKKDKVKLEIWLRQAGGQYGEVLLDDITATTDSSGTAPTLTAVSMTANTEHAYNQNTMFTFQTTYTDADNEKPFAIQVVINDTAYDLKELDAADVTYTDGKAYSYATKLPPGTHSYYFRTTDTTSNEVATPLQPGLSVVQAAQLIDVVVSQAGYSAGDFKGAKVVSSTPLTDLSYEIRNGGAVAATGSMTAEGQHWNRYVYSIDFTSITTPGSSFTIKSNGMTSYPFAISTNVWDSYKDEMTAFYRLLRAGVATEDAYPAGYSSVAPSAKLYHGAGHLDDAVSIDGTTHYNLTGGWYDAGDYGKYGGNQWVGAQIALAYLRYADSPSVKYDNDNNGIPDLIDEAIFGSEYLIKFANQLGGEMYNLKNNASFVHPEKATDNIPGTADDRKLSDLSVGGSAKSAGTLAATARAIRTAIADGDIGAAAQVELSTFADACEAAAVVFHEYVLDNPNGPIGSYSTRGGIDNSMLLADVELYLLTNEIAYKNAATDKINALVFSDLASTNYWDMRPISMAEFYPVADAATQAHIQSLLKQQVDYFLSSTDDTPYGVLNQFKNFGVNEPHASYLGDMLRYYELFGDPAALHAVQKGMYWIFGVNPWNISWVSGIGTDHVDFLHTRFDEAANTAGGTGIVLPGAMVSGPNMKDPKDKRSISPWYADRSMHQDDVSQWRYNEFSISIQAGLLYTVMGLSAMGGTSSAGGSYPAELPIQAPVIGDVVRGSVTLFAQPDANTTALEYSAGGGAYAPMTASGEAYTAVIDESAAAPYTNRRVDIRGVDASGHHTYSSTHYTVAPPLPDPSTPLLYDNFDGSGVWGGSATNTNWVNWYNQNGGTGAFAKLTENGRTIGKFSQTPTSASSAAKFQPWHDVADLSGYRYLNFKVKNPGYSELRTRIEVSDGSRTYNLTGGWVTVPAEWTDLQFDLNALVPAINKKSLKLSIWLKQNAVGYGEMLMDDITASNTASGSAPALGGASIDAASGNPLTPFTFNVTYTDADNEAPFAMELVLDGVIRQMIPVDMNDTNYSDGKAYMYTTTLPAGEHSYYFHTTDTSSDAVSTAVMAGPTVAENQVPALLLE

SEQ ID NO: 139 - DNA, 3723 bp, Artificial Sequence
  Synthetic construct
  CDS (1)..(3720)
  sig_peptide (1)..(81)
  mat_peptide (82)..(3720)
atgaagaaaccgttggggaaaattgtcgcaagcaccgcactactcatttctgttgcttttagttcatcgatagcatcagcacatcatcatcaccatcatcctagggccgttccgccgctgcctggacccggcagccctatcctctatgacgactttgccggaggcggacaatacaagcagaactggatgaactggtataaccagaatggcggaagcggaacgtttgcccgtacaaccgatggtacgcgcacagtgggcaaattcacgcaaacccctgcttccgcaagctcctgggccaaatttcagcccatgaatgagaccttctcggttgtcggctaccgttatttaaacctgtcgctgcgcagcccgggctatgaagatgcacttgtccgtattaatctgaatgatggtacccgaaattatgatctgactggcggctggaccagcgttccagatacgtggacggatatgcagttcgatctgaatgagctcgatcccgccatcaagaaggacaaagtcaagctggagatatggctcagacaggccggcggtcaatacggagaggtactgctggacgatatcactgcaacgacagattcaagcggcaccgctccaacgcttaccgccgtctctatgacggcaaatacagagcatgcctacaaccagaacacgatgttcaccttccagacaacgtacacagatgctgataacgagaagccatttgccattcaggtcgtgattaacgatacggcctatgatctgaaggagctcgatgctgccgacgtcacgtatactgacggcaaagcttattcctatgctaccaagctgccacccggcacccattcttactacttccgcaccacagacacgacctctaatgaagttgcgactcctcttcagccgggactaagcgtcgtacaagctgcccaactgatcgatgttgtggtgagccaagcgggctacagcgccggagacttcaaaggggccaaggttgtatcaagcaccccgcttacggatttgtcatacgagatcagaaacggaggcgctgtggcagccactggcagcatgaccgctgaaggccagcattggaaccggtacgtctattcgatcgacttcacgtccatcacgacgccaggcagcagctttacgatcaaaagcaatggcatgacttcttatccatttgccatatctactaacgtttgggatagctataaggatgagatgaccgccttctatcggctgttgcgcgcaggggttgccacagaggatgcctatccggccggttatagcagcgtggcgccgtcagccaagctttatcatggcgcaggccatcttgacgatgccgtatccatcgacggtacgacacattataatctgacaggcggctggtatgatgctggcgattatggcaaatatggcggcaaccaatgggtaggtgcccagatcgccctcgcctacctccgttatgccgactccccaagcgtcaagtacgacaacgataataacgggattcccgatttgatcgacgaagcgatattcggcagcgaatatctgattaagtttgccaaccagcttggcggagaaatgtacaatctcaagaacaacgcatcgttcgttcatccggagaaagcgaccgacaatattcccggcacggccgatgatcgcaagctttctgaccttagcgtaggcggctctgccaaatcggcggggacgcttgccgccactgcccgcgcgatccgcaccgctatcgctgacggcgacatcggtgcagcagcacaagtcgagctctcgacattcgcggatgcctgtgaagcggcggctgtcgtgttccatgagtatgtactggacaacccgaatggcccaattggctcctactctacgcgcggcggtatcgacaactccatgctgctcgccgatgtcgagctttacttgctcacgaacgaaatcgcttataagaatgcggctacagacaaaatcaatgcgcttgtcttcagcgatctcgcatcaacgaactattgggatatgcggccgatctctatggcggaattctatcccgtggcggatgctgcgacacaagcccatatccagagtctgctgaagcagcaggtcgattacttcctgtcctctacggatgacacgccgtatggcgtgctcaatcagttcaagaactttggtgtcaacgaaccgcatgcctcctacctgggcgacatgctgcgctactacgagctattcggcgatcccgctgcactgcacgccgtgcagaagggaatgtactggatttttggcgtcaatccgtggaatatcagttgggtgtcgggcattggaaccgatcatgtcgatttcctgcatacccgctttgacgaagcagcgaacacggcgggcggaaccggcatcgtgctacctggcgcaatggtcagcggtcccaacatgaaggatccgaaggacaaaagaagtataagcccttggtatgcggaccgttccatgcatcaggatgatgtaagccagtggcgttacaatgagttcagcataagtattcaggccggtctgctctatacggttatgggtctgagcgcaatgggcggtacaagctcagcgggcggctcttaccctgcagagcttccaatccaggcacctgtcatcggcgacgtggtacgcggcagcgtcacactgtttgctcaacctgatgcgaatacaaccgcgctcgaatactcagctggcggcggagcttacgcacctatgacagcatccggcgaggcttatacagccgtcatcgatgaaagcgcagccgctccttacacgaaccgcagagtcgatatcaggggcgtcgatgcgtctgggcatcacacctacagctctacccattacacagtagcaccgcctcttcctgatccatcgactccgcttctgtatgataactttgacggcagcggcgtttggggcggctcagctacaaataccaactgggtaaactggtataaccagaacggcggaaccggggcttttgccaaactaacagaaaacgggcgcaccatcggcaaattctcgcaaacgcccacatctgcaagctctgccgcgaagttccagccttggcatgatgtcgccgatttatccggctatcgttacctgaacttcaaagtcaaaaaccccgggtactcggagctgcgcacgcgcattgaagtatccgacggaagccgcacctataatcttactggcggctgggtcacggttcctgccgaatggaccgacctgcagtttgatctcaacgctctcgtgccggcgattaacaaaaaaagcctgaagctctccatctggctgaagcagaatgctgtcggctatggtgaaatgctgatggacgacatcaccgccagcaatacggcttctggcagcgcgcctgcactaggcggagcaagtatcgatgcggcaagcggaaatccgttaacgccgtttacctttaacgtgacctacacagatgcagacaacgaagctccttttgcaatggagctggtgctggatggcgtgatccgccaaatgattcccgtcgatatgaacgatacgaactattcggatggaaaagcttatatgtatacaacgacactgccagcaggcgaacactcctactatttccacacaaccgataccagctcggatgcggtcagcacagctgtcatggcagggccgacggttgctgagaatcaggtgccagcgctgctgctggagaattaa

SEQ ID NO: 140 - protein, 1240 aa, Artificial Sequence
  Synthetic Construct
MKKPLGKIVASTALLISVAFSSSIASAHHHHHHPRAVPPLPGPGSPILYDDFAGGGQYKQNWMNWYNQNGGSGTFARTTDGTRTVGKFTQTPASASSWAKFQPMNETFSVVGYRYLNLSLRSPGYEDALVRINLNDGTRNYDLTGGWTSVPDTWTDMQFDLNELDPAIKKDKVKLEIWLRQAGGQYGEVLLDDITATTDSSGTAPTLTAVSMTANTEHAYNQNTMFTFQTTYTDADNEKPFAIQVVINDTAYDLKELDAADVTYTDGKAYSYATKLPPGTHSYYFRTTDTTSNEVATPLQPGLSVVQAAQLIDVVVSQAGYSAGDFKGAKVVSSTPLTDLSYEIRNGGAVAATGSMTAEGQHWNRYVYSIDFTSITTPGSSFTIKSNGMTSYPFAISTNVWDSYKDEMTAFYRLLRAGVATEDAYPAGYSSVAPSAKLYHGAGHLDDAVSIDGTTHYNLTGGWYDAGDYGKYGGNQWVGAQIALAYLRYADSPSVKYDNDNNGIPDLIDEAIFGSEYLIKFANQLGGEMYNLKNNASFVHPEKATDNIPGTADDRKLSDLSVGGSAKSAGTLAATARAIRTAIADGDIGAAAQVELSTFADACEAAAVVFHEYVLDNPNGPIGSYSTRGGIDNSMLLADVELYLLTNEIAYKNAATDKINALVFSDLASTNYWDMRPISMAEFYPVADAATQAHIQSLLKQQVDYFLSSTDDTPYGVLNQFKNFGVNEPHASYLGDMLRYYELFGDPAALHAVQKGMYWIFGVNPWNISWVSGIGTDHVDFLHTRFDEAANTAGGTGIVLPGAMVSGPNMKDPKDKRSISPWYADRSMHQDDVSQWRYNEFSISIQAGLLYTVMGLSAMGGTSSAGGSYPAELPIQAPVIGDVVRGSVTLFAQPDANTTALEYSAGGGAYAPMTASGEAYTAVIDESAAAPYTNRRVDIRGVDASGHHTYSSTHYTVAPPLPDPSTPLLYDNFDGSGVWGGSATNTNWVNWYNQNGGTGAFAKLTENGRTIGKFSQTPTSASSAAKFQPWHDVADLSGYRYLNFKVKNPGYSELRTRIEVSDGSRTYNLTGGWVTVPAEWTDLQFDLNALVPAINKKSLKLSIWLKQNAVGYGEMLMDDITASNTASGSAPALGGASIDAASGNPLTPFTFNVTYTDADNEAPFAMELVLDGVIRQMIPVDMNDTNYSDGKAYMYTTTLPAGEHSYYFHTTDTSSDAVSTAVMAGPTVAENQVPALLLEN

SEQ ID NO: 141 - DNA, 34 bp, Artificial Sequence
  Primer F-C597B
tcaccatcatcctagggccgtagccccgctcccc

SEQ ID NO: 142 - DNA, 37 bp, Artificial Sequence
  Primer R-C597B
ttattgattaacgcgtttatggcgtcgttacgaggaa

SEQ ID NO: 143 - DNA, 34 bp, Artificial Sequence
  Primer F-C5B9G
tcaccatcatcctagggctccggctccgctgccg

SEQ ID NO: 144 - DNA, 37 bp, Artificial Sequence
  Primer R-C5B9G
ttattgattaacgcgtttagccccgcaccgtcacatc

SEQ ID NO: 145 - DNA, 34 bp, Artificial Sequence
  Primer F-C59T2
tcaccatcatcctagggccgtgccgccgttgccg

SEQ ID NO: 146 - DNA, 34 bp, Artificial Sequence
  Primer R-C59T2
ttattgattaacgcgtctaacttggcgtgacggt

SEQ ID NO: 147 - DNA, 41 bp, Artificial Sequence
  Primer F-C4AM9
tcaccatcatcctagggcagacgaattcgatgcaatgaggg

SEQ ID NO: 148 - DNA, 41 bp, Artificial Sequence
  Primer R-C4AM9
ttattgattaacgcgtttacggcacgaattcaaacttgacc

SEQ ID NO: 149 - DNA, 41 bp, Artificial Sequence
  Primer F-C4AKF
tcaccatcatcctaggtcagatgaatatgatacgatgcggg

SEQ ID NO: 150 - DNA, 41 bp, Artificial Sequence
  Primer R-C4AKF
ttattgattaacgcgtctaagagcctggcgccacatattca

SEQ ID NO: 151 - DNA, 34 bp, Artificial Sequence
  Primer F-C59TM
tcaccatcatcctaggtccgacgcgtatgatgca

SEQ ID NO: 152 - DNA, 37 bp, Artificial Sequence
  Primer R-C59TM
ttattgattaacgcgtctactggatcaactcaaactt

SEQ ID NO: 153 - DNA, 34 bp, Artificial Sequence
  Primer F-C59SY
tcaccatcatcctaggggcggcgaagcgagcggg

SEQ ID NO: 154 - DNA, 38 bp, Artificial Sequence
  Primer R-C59SY
ttattgattaacgcgtttacggcacatattcaaatttg

SEQ ID NO: 155 - DNA, 41 bp, Artificial Sequence
  Primer F-C3AX4
tcaccatcatcctagggcggacgaatacgacacgattaggg

SEQ ID NO: 156 - DNA, 42 bp, Artificial Sequence
  Primer R-C3AX4
ttattgattaacgcgtttattcgctgtaaatggccattccca

SEQ ID NO: 157 - DNA, 41 bp, Artificial Sequence
  Primer F-C4AKA
tcaccatcatcctagggcggacgagttcgacacgctgcgtg

SEQ ID NO: 158 - DNA, 41 bp, Artificial Sequence
  Primer R-C4AKA
ttattgattaacgcgtctaattcgcactcgtcagacgcaga

SEQ ID NO: 159 - DNA, 41 bp, Artificial Sequence; identical to SEQ ID NO: 25
  Primer F-C3BXT

SEQ ID NO: 160 - DNA, 41 bp, Artificial Sequence; identical to SEQ ID NO: 26
  Primer R-C3BXT

SEQ ID NO: 161 - DNA, 34 bp, Artificial Sequence
  Primer F-C597E
tcaccatcatcctagggccgttccgccgctgcct

SEQ ID NO: 162 - DNA, 37 bp, Artificial Sequence
  Primer R-C597E
ttattgattaacgcgtttagaagggagtcacgctaat

SEQ ID NO: 163 - DNA, 34 bp, Artificial Sequence; identical to SEQ ID NO: 161
  Primer F-C597F

SEQ ID NO: 164 - DNA, 37 bp, Artificial Sequence
  Primer R-C597F
ttattgattaacgcgtttaattctccagcagcagcgc

SEQ ID NO: 165 - DNA, 41 bp, Artificial Sequence
  Primer F-C3FCE
tcaccatcatcctagggcaacagtcaaacaagtagcagtgt

SEQ ID NO: 166 - DNA, 41 bp, Artificial Sequence
  Primer R-C3FCE
ttattgattaacgcgtttattggaccaaaatgcccgtcgtt

SEQ ID NO: 167 - DNA, 36 bp, Artificial Sequence
  Primer D14KMG
gttcatcgatcgcatcggctgctccggctccgctgc

SEQ ID NO: 168 - DNA, 45 bp, Artificial Sequence
  Primer D14KMH
ttagtggtgatggtgatgatggtcgtcgaagaacagtgtttgggc

SEQ ID NO: 169 - DNA, 37 bp, Artificial Sequence
  Primer D14N38
gttcatcgatcgcatcggctgccactccccccttgcc

SEQ ID NO: 170 - DNA, 47 bp, Artificial Sequence
  Primer D14N39
ttagtggtgatggtgatgatggtcggttaccactacgtcgtcaaaga

What is claimed is:

1. A recombinant host cell comprising an expression vector comprising a polynucleotide encoding a GH9 endoglucanase, wherein
   (a) the GH9 endoglucanase has at least 90% sequence identity to amino acids 1 to 1055 of SEQ ID NO: 2; and
   (b) the polynucleotide is operably linked to one or more control sequences that direct the production of the polypeptide.

2. The recombinant host cell of claim 1, wherein the GH9 endoglucanase has at least 92% sequence identity to amino acids 1 to 1055 of SEQ ID NO: 2.

3. The recombinant host cell of claim 1, wherein the GH9 endoglucanase has at least 94% sequence identity to amino acids 1 to 1055 of SEQ ID NO: 2.

4. The recombinant host cell of claim 1, wherein the GH9 endoglucanase has at least 95% sequence identity to amino acids 1 to 1055 of SEQ ID NO: 2.

5. The recombinant host cell of claim 1, wherein the GH9 endoglucanase has at least 97% sequence identity to amino acids 1 to 1055 of SEQ ID NO: 2.

6. The recombinant host cell of claim 1, wherein the GH9 endoglucanase has at least 98% sequence identity to amino acids 1 to 1055 of SEQ ID NO: 2.

7. The recombinant host cell of claim 1, wherein the GH9 endoglucanase has at least 99% sequence identity to amino acids 1 to 1055 of SEQ ID NO: 2.

8. The recombinant host cell of claim 1, wherein the GH9 endoglucanase is a fragment of amino acids 1 to 1055 of SEQ ID NO: 2, wherein the fragment has activity on xanthan gum pretreated with xanthan lyase, xanthan degrading activity and/or endo-β-1,4-glucanase activity.

9. The recombinant host cell of claim 1, wherein the one or more control sequences comprise a foreign control sequence.

10. A method of producing a GH9 endoglucanase, comprising
   (a) culturing a recombinant host cell of claim 1 under conditions conducive for producing the GH9 endoglucanase; and
   (b) recovering the GH9 endoglucanase.

11. A method of producing a GH9 endoglucanase, comprising
   (a) culturing a recombinant host cell of claim 2 under conditions conducive for producing the GH9 endoglucanase; and
   (b) recovering the GH9 endoglucanase.

12. A method of producing a GH9 endoglucanase, comprising
   (a) culturing a recombinant host cell of claim 3 under conditions conducive for producing the GH9 endoglucanase; and
   (b) recovering the GH9 endoglucanase.

13. A method of producing a GH9 endoglucanase, comprising
   (a) culturing a recombinant host cell of claim 4 under conditions conducive for producing the GH9 endoglucanase; and
   (b) recovering the GH9 endoglucanase.

14. A method of producing a GH9 endoglucanase, comprising
   (a) culturing a recombinant host cell of claim 5 under conditions conducive for producing the GH9 endoglucanase; and
   (b) recovering the GH9 endoglucanase.

15. A method of producing a GH9 endoglucanase, comprising
   (a) culturing a recombinant host cell of claim 6 under conditions conducive for producing the GH9 endoglucanase; and
   (b) recovering the GH9 endoglucanase.

16. A method of producing a GH9 endoglucanase, comprising
   (a) culturing a recombinant host cell of claim 7 under conditions conducive for producing the GH9 endoglucanase; and
   (b) recovering the GH9 endoglucanase.

17. A method of producing a GH9 endoglucanase, comprising
   (a) culturing a recombinant host cell of claim 8 under conditions conducive for producing the GH9 endoglucanase; and
   (b) recovering the GH9 endoglucanase.

18. A method of producing a GH9 endoglucanase, comprising
   (a) culturing a recombinant host cell of claim 9 under conditions conducive for producing the GH9 endoglucanase; and
   (b) recovering the GH9 endoglucanase.

19. A method for degrading xanthan gum comprising applying a GH9 endoglucanase having at least 90% sequence identity to amino acids 1 to 1055 of SEQ ID NO: 2 to the xanthum gum, wherein the xanthan gum is on the surface of a textile, hard surface or is a component in a borehole filtercake.

20. The method of claim 19, wherein the GH9 polypeptide has at least 95% sequence identity to amino acids 1 to 1055 of SEQ ID NO: 2.

* * * * *